United States Patent 7,745,391 (HUMAN THROMBOSPONDIN POLYPEPTIDE) - sequence listing, part 131

SEQ ID NO: 359727 - DNA, 6720 bp, Homo sapiens
  misc_feature (3127)..(3127): n is a, c, g, or t
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359728 - DNA, 6841 bp, Homo sapiens
  misc_feature (3127)..(3127): n is a, c, g, or t
  misc_feature (6798)..(6798): n is a, c, g, or t
  misc_feature (6839)..(6839): n is a, c, g, or t
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgctattccaaaatgctgaaggtgatcaagtgagtaggcaatgatgcatcatcatgaaactctctatgtaaccagtttaagggatttaggtaaaatacatctgcttcatcaagataatgactttttccagtcaggtctggcggcacggggtncagggagtgggcgtgacaggcacgaacaccatcagtggtcngg

SEQ ID NO: 359729 - DNA, 6770 bp, Homo sapiens
  misc_feature (3177)..(3177): n is a, c, g, or t
tcctctttccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359730 - DNA, 6344 bp, Homo sapiens
  misc_feature (2751)..(2751): n is a, c, g, or t
gctctcctagcacaaatagtatgattaacagattcttgtgtatcacatttgaaatgctttatgttttggctttatgttgatgagttgaaaacccgtgtttttgtttatgttgtttggtttttgtttttggctatcttatgtagaaaggcatgtaagggatggcattgattattctaaataatttttactgggaaagcttttccaagattttgaatagctaaatgtcaacttttttcttaatagtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359731 - DNA, 5946 bp, Homo sapiens
  misc_feature (35)..(35): n is a, c, g, or t
  misc_feature (2353)..(2353): n is a, c, g, or t
atttccgaatcgaaccccgttccccatcggaatgngccatagaaatggccaaatcccatggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359732 - DNA, 2438 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagaaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359733 - DNA, 1211 bp, Homo sapiens
gagacggcgacagcagcggcggcgagcgcctcgagagcgcggcggaacagcgccctatagagagtgcagcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359734 - DNA, 1190 bp, Homo sapiens
  misc_feature (679)..(680): n is a, c, g, or t
  misc_feature (855)..(855): n is a, c, g, or t
  misc_feature (863)..(863): n is a, c, g, or t
  misc_feature (865)..(865): n is a, c, g, or t
  misc_feature (876)..(876): n is a, c, g, or t
  misc_feature (890)..(890): n is a, c, g, or t
  misc_feature (917)..(917): n is a, c, g, or t
  misc_feature (925)..(925): n is a, c, g, or t
  misc_feature (928)..(928): n is a, c, g, or t
  misc_feature (932)..(932): n is a, c, g, or t
  misc_feature (937)..(937): n is a, c, g, or t
  misc_feature (946)..(947): n is a, c, g, or t
  misc_feature (962)..(962): n is a, c, g, or t
  misc_feature (964)..(964): n is a, c, g, or t
  misc_feature (970)..(970): n is a, c, g, or t
  misc_feature (973)..(974): n is a, c, g, or t
  misc_feature (977)..(977): n is a, c, g, or t
  misc_feature (980)..(980): n is a, c, g, or t
  misc_feature (984)..(985): n is a, c, g, or t
  misc_feature (994)..(994): n is a, c, g, or t
  misc_feature (996)..(996): n is a, c, g, or t
  misc_feature (1008)..(1008): n is a, c, g, or t
  misc_feature (1018)..(1018): n is a, c, g, or t
  misc_feature (1020)..(1020): n is a, c, g, or t
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactggctgaacctcctcagaagagcaactggagatagaagcatgaatcttttatccatacgttnngccaggctcgagaggtccagcaggtaactgccaaaggtggaaactgttcacacttgcctcccatcctgcctgcagaaaacccagactgcattcagtgtcctcagtgtagccaccactttgctcccaaggtggctgagcaacacattcccaagtgtaagaccatcaagaactgtcntccacctntnaggaagcattntagttgagcagacnacaatggaaacttttggatagtcaganagctctgnttntttnagccntaatggganntgaatttatgcaagnanaaaganttnnacngtnccanntctgcctgnanagctaaatctgngaggagagancncttgcttcgcagctgggggtacaacggatccccacttcccactaattacacccttgggctggcgcgttatggtattggcctgagaatggagcggtgacacctggggagttttaatcagcttttttatgtcttttttcgcaacaaaataaatagttttgctcttcccgcat

SEQ ID NO: 359735 - DNA, 926 bp, Homo sapiens
tcctctttccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgagtgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacattcagattcagaagcgtcacagttagtccaaggcagacaggggatcctctagtacgccg

SEQ ID NO: 359736 - DNA, 596 bp, Homo sapiens
gctgcatgaagcctgttttataaagaccttaatcatattcctaggggaggatcccttataactcagtcacctcctaaaggtcccacttcttagtactatcacattggcgattacattccagcgtagaaatttgtggggacaccttcagatacattcagtacaagatacagctgttgaagtttattacgtacataacctaaaaagttcagtgagtcttttttgggcttccacactacagagttgtgctcgaatagaaccatggaactcgtgagagaagtgagctcttttttctgtggttattgagggggcaaagatgggcttctcagcttctgcagcccactaggagaatgcagtggtctgatctaattctgagagttgtcaagggatctgatggtgttctcaagctatatgatgagcctgctattgcataattctttactaatagtaggaatcatatcttttattttaactcagatgactataatacttactactgttgtattctaagaaaatgtaagacccttaaatgattgttgaacttaccatctctaaaattatgattcttcaggcagaggaacaaaagatacccgaagaca

SEQ ID NO: 359737 - DNA, 406 bp, Homo sapiens
tcctctttccgtgcgcgagtgcacagctccggaggcccgagccgaccctggggcgtccggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatggtaagatgttatgtgcgtcaccctgccgggtttaatgccagcctgtcttttgatgacatttgagcccccgtgatgtcaggaatagaaagattaaatattaaataatgcccggagacttccgctaggcacgccagcctggatgatgatcaaatacctctccatatccttctccagttccagtggcctcctttagctttggt

SEQ ID NO: 359738 - DNA, 6616 bp, Homo sapiens
  misc_feature (3023)..(3023): n is a, c, g, or t
ttcatagtaaaatgtagctacccaggaatgatgaggggcaccatcatatcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359739 - DNA, 6665 bp, Homo sapiens
  misc_feature (3072)..(3072): n is a, c, g, or t
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggcatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359740 - DNA, 6368 bp, Homo sapiens
  misc_feature (2775)..(2775): n is a, c, g, or t
atcccccgggctgcaggattcggcacgagtgcagatagagcaaggagaaagcagccaaaatggcacagtgcttatggaagaaactgcttatccagctttggaggaaaccagctcaacaattgagtgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctctttatattctgtaacatgaaacttacctaatcttcaaatgttagcttcattttttacctttgaaatacttaatctttctgaataaatataatgtgtctataaaataatgagactgattctggtgtctttagtnattaagctggtatctagtcctataatgaacaaaggtgaagctgccttgaggagacaagtgaaaaatttttgcttcaaaggagctcacaagctaagtaaataaatgaaattaaggtatggggcatggtggcctcaggctgtctggaggtgtttggaaaggcttcttgagtgaggtggcctttgaactgaacttagtttttaaagtagcttttggaagagaaatgaggatttgctatgcagacagggaagggaatttcacttaaaaggaaggtcatttggagatgtgaagatacactgctttaaggaagcagggtagagctggaggataagagatgcagaccatgaagggccccattttatgctaaaggttttgtcctgtaggacatggagaacttctgaagaattttcaaggcgggtgggataagattatattgtattttagattacagtagtccccccttatcttcaggatatatgttccaagacccccagtggatgctggaaaccagggatagaacataattctatatatactatgcatgaatttctttttccttctttacaatctcacacataggtttgttcttactatagatcttaccaatctcagcatacttttatttctcttgagaaccttcaccctttcacttaaaggaggcgctttatagcttctctttggcatatccaaatgccagcatcactgttgtattttggggtcattattaagttacttagtcatccttaatccttatcttagggatacttgaacacaaacactgtggtaggataacagtatatctgattaacagactgctactaggtgattaatgggtgggtagtgtaaatacacaagaaaaggatgattcacatcccatgtgggatggagcagaactgcattatttcattacattactcagaacaggcatataattgaaaacttatgaattatttttttttaattatttgagatggaatcttgctttgtcagccaggctggagtgcagtgacacgatctcagctcactgcaacctctgtctcctgggttcaggtgattctcctccctagtctcccaagtagctgggactataggcacgtgccaccacacccggctaattttcatatttttagtagagatggggtttcaccatgttggccaggctgttcttgaaatcctgacctcaagtgatccacacatgtctacctcccaaagtgctgggattacagtcgtgagccactgtaccccgcctaaaactgatgaattatttctgaaattttctatttaacattttcagaccacagttgaccacaggtaacggaaacctcaatcacagaaagtaaagccgtggatacggtgggactaatgtattggtagcagcctagaggattgatgggaaaggtatgaagctagaaggtggtcaatataatacagacatgagctgatgaacatctaaactgggactatactagtaggagaggaaaggaaaaaacatttggaaaatagtaacattgatatttcttgtgaaggagaagtagaaagtaacagtgacttctagatttctgggttgggtcatctgttgttggatagtagtaccactgagatagggaattcaaggtttggggcaagggtaattggagatgagaattgtgtttggaggtaactactgacattcaagtggagagggttagttggcagttagttctatggtcatctcttttgccgagactgtatatttatcagactcctgggagaacaccaacatccatggggttgtagggaaggctaaggacaagagtggggagtggtaccttgaaaatccaaaagccatctcaagtaaaaggaataaatgtgtcatgctttttaaaaagttgatgtgcggaaaatgttttcttggcttggaaactgggcggccaggggatgacagtatggacttccagtgaagtagtgacggaagcctgatcatagacattaaggaaagcggtgtaggtgttgtgagcttttgctgtaagaaaaagttgagacttttgttttgctttgtttgtgagagatgtgtatgtatttctgctgagtgataaagccagcggggagggactgatttttataggaaaggaggaaaaataatggaaacacatctcattattttattgtcacatttcttttctttgttatcttttgagtgtttcccttttttgccagtagagttattgtctattttttctttctataggacaaaaaaactaatacagactcctttatttttatatggatatactaggattgtaattcagatatttaatatcttttatcagtgttcagatcatagattaatggagaaaacatttaaaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359741 - DNA, 3587 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattagttaaaagtctactaacctgcattttcctgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359742 - DNA, 3526 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatcctcaatactgattcacaattgagttaaattagacaactgtaagagaaaaatttatgctttgtataatgtttggtattgaaactaatgaaattaccaagatgacaatgtcttttcttttgtttctaagtatcagtttgataactttatattattcctcagaagcattatggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttcttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgctgagtactgtttcagtcaat

SEQ ID NO: 359743 - DNA, 2992 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacaattcagattcagaagcgtcaacagttagtcagaaagatacatgaagatgaattgaatgatatgaaggattatctttcccagtgtcaacaggaacaagaatcttttatagattataagtcattgaaagaaaatcttgcaaggtgttggacacttactgaagcagagaagatgtcctttgaaactcagaaaacgaaccttgctacagaaaatcagtatttaagagtatccctggagaaggaagaaaaagccttatcctcattacaggaagagttaaacaaactaagagaacagattagaatattggaagataaagggacaagtactgaattagttaaagaaaatcagaaacttaagcagcatttggaagaggaaaagcagaaaaaacacagctttcttagtcaaagggagactctgttgacagaagcaaagatgctaaagagagaactggagagagaacgactagtaactacggctttaaggggggaactccagcagttaagtggtagtcagttacatggcaagtcagattctcccaatgtatatactgaaaaaaaggaaatagcaatcttacgggaaagactcactgagctggaacggaagctaaccttcgaacagcagcgttctgatttgtgggaaagattgtatgttgaggcaaaagatcaaaatggaaaacaaggaacagatggaaaaaagaaagggggcagaggaagccacagggctaaaaataagtcaaaggaaacatttttgggttcagttaaggaaacatttgatgccatgaagaattctaccaaggagtttgtaaggcatcataaagagaaaattaagcaggctaaagaagctgtgaaggaaaatctgaaaaaattctcagattcagttaaatccactttcagacactttaaagataccaccaagaatatctttgatgaaaagggtaataaaagatttggtgctacaaaagaagcagctgaaaaaccaagaacagtttttagtgactatttacatccacagtataaggcacctacagaaaaccatcataatagaggccctactatgcaaaatgatggaaggaaagaaaagccagttcactttaaagaattcagaaaaaatacaaattcaaagaaatgcagtcctgggcatgattgtagagaaaattctcattctttcagaaaggcttgttctggtgtatttgattgtgctcaacaagagtccatgagcctttttaacacagtggtgaatcctataaggatggatgaatttagacagataattcaaaggtacatgttaaaagaactggatactttttgtcactggaacgaacttgatcagttcatcaataagtttttcctaaacggtgtctttatacatgatcagaagctcttcactgactttgttaatgatgttaaagattatcttagaaacatgaaggaatatgaagtagataatgatggagtatttgagaagttggatgaatatatatatagacacttctttggtcacactttttcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagtctaaaaattattagctgttacaaatggaacatttcattataacgtgatcactttgacttgagcaaatggtttaatttttatcttaaaaatcagttaagaatatataaaatcctactttggccaagtttgtttcttttcattatagtttatatgaaaagatcaccttaagtgaaattattttcctttaatcttttatgtatttattcacttttggaagctaggaatgagcaacacaaattttactctgatgggagaagatggccagtcttctcccatcagccggagaaaaacaattaataaaactaactaaataagctttccttacttactcatccagcacagattgttatttgaattgaacaaatggtaatttgcaagattgtatgagcctagtaatgagcagcacactgatgggggctagacggatcctctagatg

SEQ ID NO: 359744 - DNA, 935 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatgttgaattctgtgacccccactgacagctgtgagcccgccccagaatgttcatctttagagcaagaggagcttcaagcattgcagatagagcaaggagaaagcagccaaaatggcacagtgcttatggaagaaactgcttatccagctttggaggaaaccagctcaacaattgaggcagaggaacaaaagatacccgaagacagtatctatattggaactgccagtgatgattctgatattgttacccttgagccacctaagttagaagaaattggaaatcaagaagttgtcattgttgaagaagcacagagttcagaagactttaacatgggctcttcctctagcagccagtatactttctgtcagccagaaactgtattttcatctcagcctagtgacgatgaatcaagtagtgatgaaaccagtaatcagcccagtcctgcctttagacgacgccgtgctaggaagaagaccgtttctgcttcagaatctgaagaccggctagttgctgaacaagaaactgaaccttctaaggagttgagtaaacgtcagttcagtagtggtctcaataagtgtgttatacttgctttggtgattgcaatcagcatgggatttggccatttctatggcacattcagattcagaagcgtcacagttagtccaaggcagacaggggatcctctagtacgccg

SEQ ID NO: 359745 - DNA, 906 bp, Homo sapiens
gctgggtgtgatggctcacccctgtaatcccagctactaggaagctgaggcaggagaatcaattgaacccgggagacagaggttgcagtgagccgagatcacgctactgcactccaacccgggtgacagagcgagactccgtctacaaaaaaaaaagattccgtggttgtgaagtgtctagcacttgacgaacatgcagtaagtgttgctccttaacccctagcctatgtttcaagcaatttctgcatgtgacccacataatgttgaggctcaaagggctctgggaagatcatcttttatgagccctttgttttccagataaaaatatcaagattggggaagggacagaatggattggtggtaaaaccatttgtgtggcaaacacccagaggctgtaaaaggagcatgggtctcagagtcagcctgctgcccctcactcagtgaccctggatgagttgctgaacctccgtcagcctcagtttccttttctgtaaagtggggatgttggtgttttcggcaggattgctatgaagccacttgaattaatgtttatcaagtccctcaaggactgtcttgcagttacttataccttaattccacattggatacctgagaacactctgtcctgctgcccctcaggctgccccatatctctccagagtcactagtagggccagcagcagcccttctggcctgtgaggtttgggggcaatgaggctgctggggtggggatggagtgtgggctttgaaatcagatggacctgggccaggcaccattgctcacgcctgtaatcccaacacttcggtaggccaaggtgggaggattgcttgaacccaggagtttgagaccagcctgggcaacatggcgagatcctgtctctataaaaaatacaaaaatttggccag

SEQ ID NO: 359746 - DNA, 509 bp, Homo sapiens
ctgcaggaagaaaatacgcccctacctacaaaacttaaaagaccatttttcttgtccccaagtcgatgatgactgttggatggggcccatccaggtgactcgcatttttattacaatgattcaactttagcttcaaataaaaggggctttctttttcttttctttgttctcgaagttatttaaagaatctcattcaggtgtagaacccaaaaatttggatccaaaatgccaagtgaggcaagcagtactccactgccttcttgtgttccagagagtgaaaggaaagaataatcagctctcagcactgatagtacagaacagtcagttttaatgagaaataaccaacaggtggggtggatttcaacacacagagagggggccttagtgacgcccctgctgctgcaaggctgtgcccgcccttgagggttgggctggctctgagcagatgcagccgcgctaaacagaagggcgagtgacaccgcagggggcagcttctcgcactctctcca

SEQ ID NO: 359747 - DNA, 211 bp, Homo sapiens
ggcggggacttatcaggatcctgaacccctgaaatcactcgggagatgaggagagcttcggtgtccgccgcccagcgccgcagtctgcaatctccctggttgcggggctctgccctgccgtggccgaacgcttcgggagctcagaccacggtggcagggaggaaatggttgtttatgggtttggatgaaaggcaccacatgaatggatttt

SEQ ID NO: 359748 - DNA, 493 bp, Homo sapiens
cataactccgtgcgctctcccctcccgtcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359749 - DNA, 481 bp, Homo sapiens
gagaggcgcggggggctctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359750 - DNA, 482 bp, Homo sapiens
  misc_feature (29)..(29): n is a, c, g, or t
aaattacggctagtacgaggcctgggtgngtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359751 - DNA, 545 bp, Homo sapiens
  misc_feature (1)..(1): n is a, c, g, or t
  misc_feature (14)..(14): n is a, c, g, or t
  misc_feature (47)..(47): n is a, c, g, or t
  misc_feature (67)..(67): n is a, c, g, or t
  misc_feature (73)..(73): n is a, c, g, or t
nccccgggaaacgnctttgaccttgattccgaatttaatccgactcncttatggggaatttggcccntcgagnccaagaattcggaacgagggtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359752 - DNA, 849 bp, Homo sapiens
  misc_feature (29)..(29): n is a, c, g, or t
aaattacggctagtacgaggcctgggtgngtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagttttttttttttttttcttttttggagacagagtctgactctattgctcaggctggagtgcagtggcgcgatcttggcccactgcaacctccacctcccgggttcaagtgattgtcctgtctcagccgcctgagtaactgggatta

SEQ ID NO: 359753 - DNA, 759 bp, Homo sapiens
gagaggcgcggggggctctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctggg

SEQ ID NO: 359754 - DNA, 1196 bp, Homo sapiens
  misc_feature (1)..(1): n is a, c, g, or t
  misc_feature (14)..(14): n is a, c, g, or t
  misc_feature (47)..(47): n is a, c, g, or t
  misc_feature (67)..(67): n is a, c, g, or t
  misc_feature (73)..(73): n is a, c, g, or t
  misc_feature (682)..(682): n is a, c, g, or t
  misc_feature (687)..(687): n is a, c, g, or t
nccccgggaaacgnctttgaccttgattccgaatttaatccgactcncttatggggaatttggcccntcgagnccaagaattcggaacgagggtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaaaaaaaaaaaaaaaaaaaaaaaaaaaaaaaaaacaaaaaaaagaaaaaaaaaaacaaaaaagaaaacaaaaaaaaaacaagaaaaaanaaaanacaaagagagcgggggcccactatagcacattatatgtcgcacagagcgagagacaaacctatacgtccactaccacgccatacttattttacagcagacagtgcccctaaaattgataggtgtacttatctgaaagaagagaggcgaggccgagactcggatattatctactcctctgtggtgtgacagcacaatggacttgttagcggatgacttatctagcgtagagaagcgaaccacaaccagacgagaggcggacggcaagcacaacatatgaatgaaacacgacaacccacccacgcaacaagagctgaactacttaactgcgacatggaaccgaacatagtaactaaactaactaccacctagcatgagatgataatcaagatgatagatgacgcataacaaaaccacgaagaatataccgcacgcacgaggacacagaaagcaagagccatccctagcacagctgaatcactatagagaacacaataaaattttacgccgc

SEQ ID NO: 359755 - DNA, 376 bp, Homo sapiens
  misc_feature (4)..(4): n is a, c, g, or t
  misc_feature (15)..(16): n is a, c, g, or t
  misc_feature (23)..(23): n is a, c, g, or t
cccngtgccttattnnggccccntgccccccaaagtccatccgtcccggtttcctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359756 - DNA, 390 bp, Homo sapiens
  misc_feature (51)..(51): n is a, c, g, or t
gttaataactattttccctttttttatttttattggagagtttcgtgtggncgtgatcgccccatatttgacgtgcaactcaaagacctggaaaaatggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359757 - DNA, 299 bp, Homo sapiens
  misc_feature (18)..(18): n is a, c, g, or t
cctactactactaaattngcggccgctcgacacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359758 - DNA, 419 bp, Homo sapiens
tttttagccgggtgtggtggctcacgcctgtaatcccaacactttgggaggccgaggtgggcagatcacttgatgtcaggggtttgagacgagcctggccaacatggtgaaaccccgtctctactaaaaatacaaaaattagccgggtgtgatggcgggcgcctgtaatctcagcctccctagtagctgagattacagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359759 - DNA, 287 bp, Homo sapiens
tcaacgctttatactttcatccacgtttttaacttcttgtgtcttgtaactgctcggctcatacagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359760 - DNA, 556 bp, Homo sapiens
  misc_feature (29)..(29): n is a, c, g, or t
aaattacggctagtacgaggcctgggtgngtctttccgcgcccatccgtctgccatcggcgccatcctgcaatctaaaggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcagccacaatggtgcgcatgaatgtcctggcagatgctctcaaggaagttacttcaaaccaaattggccccgaacacaaacggcaagggaccacggggggggcccaaaagaaaccgaccccaaggttgcccgc

SEQ ID NO: 359761 - DNA, 264 bp, Homo sapiens
  misc_feature (51)..(51): n is a, c, g, or t
gttaataactattttccctttttttatttttattggagagtttcgtgtggncgtgatcgccccatatttgacgtgcaactcaaagacctggaaaaagcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359762 - DNA, 438 bp, Homo sapiens
gcagtctccttttgaaataggttgtctgtacatgttctaatgttttgtagaacacgtgtgcctgtttaagtgtattgatgtgaataatattaaatatcctaattatttaattcattgtattgtttctgagaagttgggaaattaccattatacatttacaacctaatgacttttgtattttatttttcaaaataaaagctttcaatgtgaaaaaaaaaaaaaaaaagggcggcgctcgcatctagaaccggacgcgtgggtggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359763 - DNA, 220 bp, Homo sapiens
gcggccgcctactactactaaattcacagccggtcgacaagacctggaaaaagcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359764 - DNA, 199 bp, Homo sapiens
  misc_feature (18)..(18): n is a, c, g, or t
cctactactactaaattngcggccgctcgacgcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359765 - DNA, 893 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaaaggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359766 - DNA, 944 bp, Homo sapiens
aatcgccacacaccagcaaagccaggctatgctatagtacaagccactagcccgcctctcagaacctctcatttcctttccatcgtggaaatctatcctcaaggaaataacttctcagtgtttcatctgctattctactactcctcagtgattattcaggccccctcccttccctacacatcaagctccaggatttgcccccacccaggactggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359767 - DNA, 919 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggttgcctcaatgaaataaaagaggatacaaacaaatggaagaacattccatgctcatgg

SEQ ID NO: 359768 - DNA, 885 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaacaaaaaaaaaaaaaaaaaaaaaaaaagaaaaaaaacgcttggccccctttttttttaatttgggagagtttttttgttcgggccaattttaggctcttttggccaattgccctttgggaggcggataaaacaaccggggccggttttacacgggggagaggg

SEQ ID NO: 359769 - DNA, 916 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaagccctggcggggcctatttttctgggggggggaaaaaagggtgttaaaaaaggggcactggggaaagtgtgttttccgtggcaccagtttttttttaaaaaggggggaaatatcggggggccccccatatagggggcatataaattcagaaaacccggttacctgtatatttttgttcaaaaacgcggaagaa

SEQ ID NO: 359770 - DNA, 1098 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaagggggggggcgccgcaaaaaaaatcccacggagagggacaccaattgttaccgcaccccccgcgttttttattaaaagaagggggccccccttatggggcgcggtttattatatacacgcgcgcggcgcggccgccccggtgttaaaaaaccgcgtgcgtcggtcggaggaacaaagcgcggtcgcgtggagctcttttttggagagagcccccatccttcctcgggggggggcgccacattggctcggccaccaccctccctctaggggatgtttttcccccctctcggggggtaatattacaccttttgccggcttcatttggctggctgtaccccccggcctattttttctgtgcgtccgttaggagacctt

SEQ ID NO: 359771 - DNA, 727 bp, Homo sapiens
gagaggcgcggggggctctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggttgcctcaatgaaataaaagaggatacaaacaaatggaagaacattccatgctcatgg

SEQ ID NO: 359772 - DNA, 1088 bp, Homo sapiens
  misc_feature (696)..(696): n is a, c, g, or t
  misc_feature (701)..(701): n is a, c, g, or t
  misc_feature (897)..(897): n is a, c, g, or t
  misc_feature (920)..(920): n is a, c, g, or t
  misc_feature (927)..(927): n is a, c, g, or t
  misc_feature (1007)..(1008): n is a, c, g, or t
  misc_feature (1013)..(1013): n is a, c, g, or t
  misc_feature (1016)..(1017): n is a, c, g, or t
  misc_feature (1019)..(1019): n is a, c, g, or t
  misc_feature (1022)..(1022): n is a, c, g, or t
  misc_feature (1024)..(1024): n is a, c, g, or t
  misc_feature (1034)..(1034): n is a, c, g, or t
  misc_feature (1037)..(1037): n is a, c, g, or t
  misc_feature (1044)..(1044): n is a, c, g, or t
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaacncgggnaaacaagttctctcttctctctccccgaaagggaaaaaaggccaggggaaaagaaggggggccccggccccagttgtccgtgaaaaaaccaggaggctaaagaaagggggtgaacccccgtgtttggaaaaagggcctaaaaattggggcatgggacaggacatccagcccaaaagagacctcacccgttttggtnaaatgggccccgaaatatcaggntggcagngcggaaaagagccatcctatataaaggggctgaaagtgcccccggggaataccagttcacccaggccctggaccgcaaanngtacncanngntangnggcccaagtncgnccgaganaggcgagaaaacgcaaatgtgccggcgaaaaggcgcgccaggga

SEQ ID NO: 359773 - DNA, 1258 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaattctgggcacccggttacggcccaaaaccaaaggtccccggagaatccgggatgtaacaagggatggagcgaatcggggcccactcccacatccgggggactgggggctgggacagatgcctgggagcctcggaaggcttcgcaggggcatggggggtcagtggcggcacggcgggcgggtgcgtgttgctgaaaatgatccgggacgggaagatggccggcgggcagccttatgttggccagccgggcccggggaagacggcatccgcatggattggggagaggcctgggccgtgaaagcattcaaagcatcgccggaggggaaacctccccgggagatgagcaaacccagcgtgacgcgagctccgggggacacggcgcgatagaggaaccggagaccccgaggggggggggaacccaattgcaccgcagggcggcccaggggatgccaaaacaagatggacattagcgggcagaatgctctcgaggaggcggggcgaccgcgggggaaacaggggcaacgcgaatgcacactggcagggcacaagggggcaacccgcgtaggaag

SEQ ID NO: 359774 - DNA, 1308 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaatgtgtgtgtgcggcgcgcgcccgcgcggccccctgcggaaaagctttcttgagaaaccattcgcgttgtgggcgccgcggggggcccacagaaggggataacgtggaaccacgtgcggcaataagcggtgttacccaagaggagaaactcggtggctcagaaacaaggtggatgggagactcctcacccaattataaaaagcaccccgcggcgggacaacaccagagagcggggtctagcggaacaaatctccccaaagatgaggggcactccccggagggcgccactactacagcgggggactcttataacaacaggagagggtccacacagcagagacgccgcgacaattatacaaaagatataacgcccccggaacgcggggagccaccaacacacgacgccacgcagggcaacgcacacccgaccaaaccaccaggggaacacgaaacacacacagaagcacgacgagccagctcccaacgggcccccaagaggcacgaagaccacccaggcaacaacaggcccgcggcgaagcagaacaccactcacccacaagcagccggaaaccacccgacgcacgccaccacagggaaaagccgaaca

SEQ ID NO: 359775 - DNA, 832 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccaaaaaaaaaaaaaaaaaccggggactagttcctctctctcgagagagagaactagtcctcgagttttttcttttcttttcccagggtctccaactctggtttaaactcttctataccgggtcccctttttttccccccttttttccg

SEQ ID NO: 359776 - DNA, 820 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaatacgttctacggtcctaccaattattccccattgtcaatcacttggcccggtttggggtccaaaacctcaagggggggccgggaccccaattctccttatagcgagtcttattacactttactgcccgtggttttcaaacgctc

SEQ ID NO: 359777 - DNA, 704 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccaaaaaaaaaaaaaaaaaccggggactagttcctctctctcgagagagagaactagtcctcgagttttttcttttcttttcccagggtctccaactctggtttaaactcttctataccgggtcccctttttttccccccttttttccg

SEQ ID NO: 359778 - DNA, 738 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaacttccggggctttttatattgtcggggtggcgggaaaaagggtgttttggaattgggcccttgggcctataagtctgttccctggacccagtttttttggtccaagggggaagtctggcccggtcccctaataggggagccgtataaattccgaaaagccgggtacccgcta

SEQ ID NO: 359779 - DNA, 746 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggaatttataccctccaaattatgcgtctggtgccttggttgaaagtattctcacttcatggttgctgtattacgtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359780 - DNA, 1210 bp, Homo sapiens
ttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359781 - DNA, 548 bp, Homo sapiens
gcggccgcgctgggagcttgggaggctgaggccacccagcacaggtaaaagctgcatcgtgccggggttggcagtttgctgggtgccaacttggatcttctgggccgcagagtttttctttagacacttttgaacttaaggaatttaagttctactctttactattggcactttggtctttcaaaacttcagtgtagtgtgcggttcttgcccattagaagagagtccagtctgacaagcatgtaaaatgtttctgtttgccactgtggctcttgctgttggacgcaattttaaatggcacgaagatggatgtttaatagttagatgtgttcattgtaggtgagagtgaactgatttaaagtacaatgttaatagtatggaatctgctgattttcagcaatttggaaaatgttgccgatgatactctgcttctgttctgaatcactgatcgactatacccgatgttttccttccggtagctggcagtttctgccagttctcacgttgtcttgtgtcaagtggattttgtcccacattttattatctcc

SEQ ID NO: 359782 - DNA, 713 bp, Homo sapiens
aggcggaggttacagtgagctgagatcgcaccactgcactccagcctgggtaacagggcaagactccctaagatttgaagaacttgcaagggtaattttcagtatgtcatgttttgttctagttgtagccattagaaccccacctcaaaataggattgatttatttttatttatatttcttttgagatagtcttgctctggttgaggctggagtgcagtggcgccatcttggctcactgcagcttccctagctcaagccatcctcccacctcagcctcctgagtagctggggaatacaggtgcattccactgtgactgctgatttttctttaacttttttgtagaggtggggtctcgctatgttgcttaggtttgtcttggactcatgggctcaagtgatcctcccacctcagcctcccagagtgctgggattacaggtgtgagtcactgggcccagccgagaaataaatttgaacagagcattctgtaaatggaacttatttgtggcacccttgttctgtggtatgctagtttgaaaaattctagcctacaacagttgatatgcaggccctgctgctctctgcccgttttttgagacggagtctcactctcacccaggttggagtgcagtggcacgatcttggctactgcaacctctgtctcccaggttcaagcgattctcctgcctcagcctccctagtagctgagattac

SEQ ID NO: 359783 - DNA, 912 bp, Homo sapiens
  misc_feature (1)..(1): n is a, c, g, or t
  misc_feature (14)..(14): n is a, c, g, or t
  misc_feature (47)..(47): n is a, c, g, or t
  misc_feature (67)..(67): n is a, c, g, or t
  misc_feature (73)..(73): n is a, c, g, or t
nccccgggaaacgnctttgaccttgattccgaatttaatccgactcncttatggggaatttggcccntcgagnccaagaattcggaacgagggtctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagttttttttttttttttcttttttggagacagagtctgactctattgctcaggctggagtgcagtggcgcgatcttggcccactgcaacctccacctcccgggttcaagtgattgtcctgtctcagccgcctgagtaactgggatta

SEQ ID NO: 359784 - DNA, 1130 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaattctgggcacccggttacggcccaaaaccaaaggtccccggagaatccgggatgtaacaagggatggagcgaatcggggcccactcccacatccgggggactgggggctgggacagatgcctgggagcctcggaaggcttcgcaggggcatggggggtcagtggcggcacggcgggcgggtgcgtgttgctgaaaatgatccgggacgggaagatggccggcgggcagccttatgttggccagccgggcccggggaagacggcatccgcatggattggggagaggcctgggccgtgaaagcattcaaagcatcgccggaggggaaacctccccgggagatgagcaaacccagcgtgacgcgagctccgggggacacggcgcgatagaggaaccggagaccccgaggggggggggaacccaattgcaccgcagggcggcccaggggatgccaaaacaagatggacattagcgggcagaatgctctcgaggaggcggggcgaccgcgggggaaacaggggcaacgcgaatgcacactggcagggcacaagggggcaacccgcgtaggaag

SEQ ID NO: 359785 - DNA, 673 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359786 - DNA, 1040 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagttttttttttttttttcttttttggagacagagtctgactctattgctcaggctggagtgcagtggcgcgatcttggcccactgcaacctccacctcccgggttcaagtgattgtcctgtctcagccgcctgagtaactgggatta

SEQ ID NO: 359787 - DNA, 1044 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaagggggggggggtaaaaaatttcccggggggggcccaattttgggtcccgttttttttggtaaggggggccccatattgaaggaggcgtattataaaagctagggcgggggcgcctgttttataaaacgtgtgtgtagtgggaaaaagggtccgcttggcgacattttgggagaagaaacactactctctgtgggggggacaatttgtgggaaattcttaggagtataaggttccgggaaaataaaatctgggggttagtgtgtgtaacagcgcatatgtgcgtgagaatgtctgggtgtatataatatgggcaacataagt

SEQ ID NO: 359788 - DNA, 1324 bp, Homo sapiens
  misc_feature (810)..(810): n is a, c, g, or t
  misc_feature (815)..(815): n is a, c, g, or t
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaaaaaaaaaaaaaaaaaaaaaaaaaaaaaaaaaacaaaaaaaagaaaaaaaaaaacaaaaaagaaaacaaaaaaaaaacaagaaaaaanaaaanacaaagagagcgggggcccactatagcacattatatgtcgcacagagcgagagacaaacctatacgtccactaccacgccatacttattttacagcagacagtgcccctaaaattgataggtgtacttatctgaaagaagagaggcgaggccgagactcggatattatctactcctctgtggtgtgacagcacaatggacttgttagcggatgacttatctagcgtagagaagcgaaccacaaccagacgagaggcggacggcaagcacaacatatgaatgaaacacgacaacccacccacgcaacaagagctgaactacttaactgcgacatggaaccgaacatagtaactaaactaactaccacctagcatgagatgataatcaagatgatagatgacgcataacaaaaccacgaagaatataccgcacgcacgaggacacagaaagcaagagccatccctagcacagctgaatcactatagagaacacaataaaattttacgccgc

SEQ ID NO: 359789 - DNA, 723 bp, Homo sapiens
  misc_feature (688)..(688): n is a, c, g, or t
  misc_feature (698)..(698): n is a, c, g, or t
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgaaaaaaanaagtcgagcngccgcgaatttagtagtagtagtcg

SEQ ID NO: 359790 - DNA, 1248 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaacaaaaaacaaaagaacgcgcgcccaaacacaaaacaaatcacacacaacagagagacaccatgcgaatcaacagcaaaaaccacaacggatcgctgacgacacaaagaggcaccccccaaaacgagaaggctcgaacactacagcacgttgcgaccacgagcccacacagtcacaacggtgacccagacgccgggaacaaccgtgagtcaccagaggcgccgacaaatcggccgcacaccggacaccccccaaccctcgcccaggcaggcaacgaaccacccactcgaggaaaaaagaccaccaccacaaaacaacaaacaaaccaccaacaaggtaacacctcgcaagcgccccccaccccgcgtacacaaagcggcaacacaaggaccgcgagcccccagagcccagaacgacacgccacgcctgcccccgccagcacacgacacgcaagccaacagcacgacacaacgtccccagccaccacgcacgcccccacaccaccccatcccaaaagaacgagaaagaggcgcacgcaccacgagcgacaccgcacgaag

SEQ ID NO: 359791 - DNA, 1274 bp, Homo sapiens
  misc_feature (760)..(760): n is a, c, g, or t
  misc_feature (765)..(765): n is a, c, g, or t
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaacaaaaaaaagaaaaaaaaaaacaaaaaagaaaacaaaaaaaaaacaagaaaaaanaaaanacaaagagagcgggggcccactatagcacattatatgtcgcacagagcgagagacaaacctatacgtccactaccacgccatacttattttacagcagacagtgcccctaaaattgataggtgtacttatctgaaagaagagaggcgaggccgagactcggatattatctactcctctgtggtgtgacagcacaatggacttgttagcggatgacttatctagcgtagagaagcgaaccacaaccagacgagaggcggacggcaagcacaacatatgaatgaaacacgacaacccacccacgcaacaagagctgaactacttaactgcgacatggaaccgaacatagtaactaaactaactaccacctagcatgagatgataatcaagatgatagatgacgcataacaaaaccacgaagaatataccgcacgcacgaggacacagaaagcaagagccatccctagcacagctgaatcactatagagaacacaataaaattttacgccgc

SEQ ID NO: 359792 - DNA, 790 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgaaagcctcgacatgaagctttcatcccccttatctatccatttggcttttaattttttgatatagaacaaacaggagagagagtgaaatgtgtggttaagagccttggcatgaaggcgctcgacatgaatcatgtcgaggccctcgatatgaa

SEQ ID NO: 359793 - DNA, 1285 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359794 - DNA, 1886 bp, Homo sapiens
  misc_feature (1372)..(1372): n is a, c, g, or t
  misc_feature (1377)..(1377): n is a, c, g, or t
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaacaaaaaaaagaaaaaaaaaaacaaaaaagaaaacaaaaaaaaaacaagaaaaaanaaaanacaaagagagcgggggcccactatagcacattatatgtcgcacagagcgagagacaaacctatacgtccactaccacgccatacttattttacagcagacagtgcccctaaaattgataggtgtacttatctgaaagaagagaggcgaggccgagactcggatattatctactcctctgtggtgtgacagcacaatggacttgttagcggatgacttatctagcgtagagaagcgaaccacaaccagacgagaggcggacggcaagcacaacatatgaatgaaacacgacaacccacccacgcaacaagagctgaactacttaactgcgacatggaaccgaacatagtaactaaactaactaccacctagcatgagatgataatcaagatgatagatgacgcataacaaaaccacgaagaatataccgcacgcacgaggacacagaaagcaagagccatccctagcacagctgaatcactatagagaacacaataaaattttacgccgc

SEQ ID NO: 359795 - DNA, 770 bp, Homo sapiens
cccactctcctctttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggggtgtgccctcgtgccgcccactctcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaaggttggagtgcagtggcacgatcttggctactgcaacctctgtctcccaggttcaagcgattctcctgcctcagcctccctagtagctgagattacagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359796 - DNA, 916 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggacaaaaaaaaaaaaaaaaaaaaaaaaaaaaaaaaaaaaaaaaaaaaaaaaaagggggggggggtaaaaaatttcccggggggggcccaattttgggtcccgttttttttggtaaggggggccccatattgaaggaggcgtattataaaagctagggcgggggcgcctgttttataaaacgtgtgtgtagtgggaaaaagggtccgcttggcgacattttgggagaagaaacactactctctgtgggggggacaatttgtgggaaattcttaggagtataaggttccgggaaaataaaatctgggggttagtgtgtgtaacagcgcatatgtgcgtgagaatgtctgggtgtatataatatgggcaacataagt

SEQ ID NO: 359797 - DNA, 545 bp, Homo sapiens
  misc_feature (15)..(15): n is a, c, g, or t
  misc_feature (23)..(23): n is a, c, g, or t
ggacgcgtgggtcgncccactcntccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 359798 - DNA, 540 bp, Homo sapiens
aaatttagagtcttgctatgttgctcagactgatctcgaactcctgagctcaagtgatcctccttctcagcttcctgagtagctgggactataataggctttgtgccaccatgcccagcttacttttttctatttctgctttattttatcctcatgtctggaccatagatagatcattgttatccaccagcaagaatgtgtcatggcataaaacagtcaagaaatctaagtgaaaccttgactgggctgtctttgggcttgtgcggtaatgcctcacatgcagtgaactctcaacaaatggcttttaaattgaattggaatcttccatttctatattagcacattttgtacctttaggaaaaacttgattttaatgtgttgttttcgtatgtgtttgcttgtttcttgagtagctgatggatttacaactgagtgacagtaactttcgtcgacacatcctgttgcagtatctcattttattccaatatctcaaggggcaggtcaaattcaaaaggtaagataatatgggtagtaaacaat

SEQ ID NO: 359799 - DNA, 448 bp, Homo sapiens
aaaccttgttattttttgaagataatcttttcaaatcacaaagacaatttagcaacattacaaaacatttagaaataagaagggaaaacagtactcttaattcctctacttttaaaagctaccattcatctggtataatggttttagtttctatagtcttttaagaattttttttattgtcataaccatatgtacatacaattttgaatcctgccttttttcacttagcattatatcataagcatttttccaagttattatagtcgttataaccatcatttttaattggctgcattatattcttttgaatagcttagtggtgaagaaaacagactgtggagccagactgcctgggttcgtatcccagctctaccacttactggctctatgatcttggtgaagttatttaacctctctgtgtctcagttttcccattctataaaatgca

SEQ ID NO: 359800 - DNA, 3991 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359801 - DNA, 3937 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaacatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359802 - DNA, 3168 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctcagccttgcctgtaaggtctttgagaagggagaggagtaggcca

SEQ ID NO: 359803 - DNA, 4012 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagtgtatgttttgttcaccacagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359804 - DNA, 3940 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaacatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359805 - DNA, 4033 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaagcttagtggtgaagaaaacagactgtggagccagactgcctgggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359806 - DNA, 2160 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttggtgtagcgcccaggtttttttttctgtaccctctctccctccttcggcgccctc

SEQ ID NO: 359807 - DNA, 3515 bp, Homo sapiens
agggaatggtagagaaactggattgcaaagaattgaaggaaatctcaaatcctcagcttaaaagtgtgtcacaactgccaagcaggataaagaaagataaatctactcttcattacatcatgccataactgtgggcattcagagaaaacctaaaagccactaagggataagaaagacaaatatactgggaaggcacagcagtttgactgttagcagatttctaacatatcaaccattaataccagaagacagtagagaaatattaaagtgctgaaagaaaaatgacattcaatctagaattttataccgagttaaatatactcaagactgtcgatgaaagaaagacatttttatttaaagaccaggataacttaccactcagtgaccctcattttgaaaaaaactactcaaggatgttcttcaggaggaaggaaattgaacccataagaatggagtgggatacagaaggcaacgctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359808 - DNA, 3478 bp, Homo sapiens
caatgaataatgtatgtaaagtgttcagatcctagccatcaatatttattggatgtctttaaatcacctagtgcattatgagagctcagttagtggcagctattaacaatttgggtttgcctgttgccttttctagggtttgggtgttttattcgttgtattttgaatgaatcttaatgtagcatgccatactgaatgtgcatcatgtatacacatatcttaatatcaaatcagaagttttcgtttcacactcagcttattttaggaaacatatattgctctgttcatagtgaatctgattgattaattgaatgttttattccctgcatatgcttttatgtcttcagtaccaaccctcttgaggaagaagtgcaagaattttctcttataatcctctcatttgtgattattcttgtcttggtaatttttgacactatccacagtatagttacatgttacatgccttgtgttttttaaaccttaaagttgcatatgcattgctgtaactcaagcatgctttcattgctttgttccctagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359809 - DNA, 3712 bp, Homo sapiens
agggaatggtagagaaactggattgcaaagaattgaaggaaatctcaaatcctcagcttaaaagtgtgtcacaactgccaagcaggataaagaaagataaatctactcttcattacatcatgccataactgtgggcattcagagaaaacctaaaagccactaagggataagaaagacaaatatactgggaaggcacagcagtttgactgttagcagatttctaacatatcaaccattaataccagaagacagtagagaaatattaaagtgctgaaagaaaaatgacattcaatctagaattttataccgagttaaatatactcaagactgtcgatgaaagaaagacatttttatttaaagaccaggataacttaccactcagtgaccctcattttgaaaaaaactactcaaggatgttcttcaggaggaaggaaattgaacccataagaatggagtgggatacagaaggcaacgctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaagtaagttcaacacgcaacaaacccatgattgaaaaaatggaaatttaggattttctttgtttcagccccaaataggaaaataaggataaagttaagctcaggtacaagaccacaaacactccttggttctctgcctacaaaccactcctatgatgcagaaagttgttgaaagcttagtatattctttctaatcacagctactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359810 - DNA, 3675 bp, Homo sapiens
caatgaataatgtatgtaaagtgttcagatcctagccatcaatatttattggatgtctttaaatcacctagtgcattatgagagctcagttagtggcagctattaacaatttgggtttgcctgttgccttttctagggtttgggtgttttattcgttgtattttgaatgaatcttaatgtagcatgccatactgaatgtgcatcatgtatacacatatcttaatatcaaatcagaagttttcgtttcacactcagcttattttaggaaacatatattgctctgttcatagtgaatctgattgattaattgaatgttttattccctgcatatgcttttatgtcttcagtaccaaccctcttgaggaagaagtgcaagaattttctcttataatcctctcatttgtgattattcttgtcttggtaatttttgacactatccacagtatagttacatgttacatgccttgtgttttttaaaccttaaagttgcatatgcattgctgtaactcaagcatgctttcattgctttgttccctagttcaaactatgttttaactgatgagcaatcactttggattgaagatactacaaaatcagtttatcaagtaagttcaacacgcaacaaacccatgattgaaaaaatggaaatttaggattttctttgtttcagccccaaataggaaaataaggataaagttaagctcaggtacaagaccacaaacactccttggttctctgcctacaaaccactcctatgatgcagaaagttgttgaaagcttagtatattctttctaatcacagctactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359811 - DNA, 2849 bp, Homo sapiens
  misc_feature (16)..(16): n is a, c, g, or t
  misc_feature (19)..(19): n is a, c, g, or t
  misc_feature (26)..(26): n is a, c, g, or t
  misc_feature (36)..(36): n is a, c, g, or t
  misc_feature (43)..(43): n is a, c, g, or t
  misc_feature (49)..(50): n is a, c, g, or t
  misc_feature (54)..(55): n is a, c, g, or t
  misc_feature (58)..(60): n is a, c, g, or t
  misc_feature (77)..(77): n is a, c, g, or t
  misc_feature (80)..(80): n is a, c, g, or t
cgactctagaggatcncgnatatgcngtctcatgtnataagtnagactnnctgnnagnnncttaatccagacttatncantgcattaatcagattctcaggtgtgcatgaactccctcttgatcttgccaggcaaccaggagctgcttagctctcatcttcatgtcttcacatgcccacaatcttgtcctgccaccactttatgagtatttattattaagaatatatgccatcctcactggttatttttgtaccgctcagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359812 - DNA, 2631 bp, Homo sapiens
aaatcctggaactgtgctttttactgacttcctgcttcccagattgggggtggggagtctttccaactctgaggtcttcccaagttcactccttctgcaggtgaagatagtcccacttaggatccttacctgacactgtcatttaacgctctcaggggtgaggttctggcaccctgtacttggaatctcacaaccgtccttatccaaacaaaatacctgttaccttacttcagaggctggcattctttcaaacattcttctttctcatttttagcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359813 - DNA, 1957 bp, Homo sapiens
  misc_feature (1957)..(1957): n is a, c, g, or t
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaatgaacagcattaatatttagaaacagtgtcaagttaacgataggtagccctggagttgtgagcactgtggaggtgtttgtgtttagtgcgcagcaacgttgatataattggtgattgcggaggatattgaagttatagagtcggggctcgcggtggattgatctgatttcttcagtcatagtatggacgcgtaggatttcattatgcggatctagttaatggcttatagtgtgaggacgcgaaggtacagtgggtatatgaaggaggccgtgaggggatggagatatgtcaggggtgtggaggttgcatacagaacattacatgattaccggtgcttcaattcaataagaaagtcaggacgcgaggactaatgtgtcatcgttcgcacccctgtacggaggagttccactgctaatatggtaacagctcaggcgaaactatgtagagattagatcagaaacttgaagtan

SEQ ID NO: 359814 - DNA, 1995 bp, Homo sapiens
  misc_feature (1523)..(1523): n is a, c, g, or t
  misc_feature (1534)..(1534): n is a, c, g, or t
  misc_feature (1559)..(1559): n is a, c, g, or t
  misc_feature (1588)..(1588): n is a, c, g, or t
  misc_feature (1597)..(1597): n is a, c, g, or t
  misc_feature (1602)..(1602): n is a, c, g, or t
  misc_feature (1604)..(1605): n is a, c, g, or t
  misc_feature (1609)..(1609): n is a, c, g, or t
  misc_feature (1611)..(1611): n is a, c, g, or t
  misc_feature (1614)..(1614): n is a, c, g, or t
  misc_feature (1620)..(1620): n is a, c, g, or t
  misc_feature (1627)..(1627): n is a, c, g, or t
  misc_feature (1633)..(1633): n is a, c, g, or t
  misc_feature (1646)..(1647): n is a, c, g, or t
  misc_feature (1673)..(1673): n is a, c, g, or t
  misc_feature (1689)..(1689): n is a, c, g, or t
  misc_feature (1695)..(1695): n is a, c, g, or t
  misc_feature (1699)..(1699): n is a, c, g, or t
  misc_feature (1702)..(1702): n is a, c, g, or t
  misc_feature (1715)..(1715): n is a, c, g, or t
  misc_feature (1718)..(1719): n is a, c, g, or t
  misc_feature (1740)..(1740): n is a, c, g, or t
  misc_feature (1748)..(1748): n is a, c, g, or t
  misc_feature (1750)..(1750): n is a, c, g, or t
  misc_feature (1760)..(1760): n is a, c, g, or t
  misc_feature (1769)..(1769): n is a, c, g, or t
  misc_feature (1780)..(1781): n is a, c, g, or t
  misc_feature (1788)..(1788): n is a, c, g, or t
  misc_feature (1800)..(1800): n is a, c, g, or t
  misc_feature (1814)..(1814): n is a, c, g, or t
  misc_feature (1834)..(1834): n is a, c, g, or t
  misc_feature (1836)..(1836): n is a, c, g, or t
  misc_feature (1848)..(1848): n is a, c, g, or t
  misc_feature (1850)..(1850): n is a, c, g, or t
  misc_feature (1852)..(1852): n is a, c, g, or t
  misc_feature (1859)..(1860): n is a, c, g, or t
  misc_feature (1863)..(1863): n is a, c, g, or t
  misc_feature (1866)..(1866): n is a, c, g, or t
  misc_feature (1870)..(1871): n is a, c, g, or t
  misc_feature (1873)..(1874): n is a, c, g, or t
  misc_feature (1878)..(1878): n is a, c, g, or t
  misc_feature (1893)..(1894): n is a, c, g, or t
  misc_feature (1903)..(1903): n is a, c, g, or t
  misc_feature (1906)..(1906): n is a, c, g, or t
  misc_feature (1915)..(1915): n is a, c, g, or t
  misc_feature (1925)..(1925): n is a, c, g, or t
  misc_feature (1954)..(1954): n is a, c, g, or t
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaaaaagaaaataaaaataaagaaataaaaaaaaaaaantaaaaaaaganaaaaaaaagaatataaaaaaaaaanaaaacaaaaattaaaaacaacaaaaaaanaaaaaattnaaaantnnaaananaanataatnaaaaaanaataanaaaaataaaaaannaaataaaaaaaaaaatatgaagaaanaaaaaaaggagaggangaagangaanaanataaagaagaaanaannaagaaaaatgaaagtaatgangataggananaaaaaaatanaaaaaaaanaaaaaaaagannaaaaatncaaaaaaaaaangggtgaaaaaaagnaaaaaaatggcaccataaanangaaatgaaagantnanaaattannaanaanaganngnnaaantgaagaaaagaagannaaaaaaaancanataatggangaatggaaanataaagagggaggtaaagaaaaaagtganaaaaatgaaataaaggaaatgaataagtatggaaataagtg

SEQ ID NO: 359815 - DNA, 1207 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaaggtataagtttttctttttcattaagcataataagaaatggtcttgttttatttccgtttagctgacagcctttctaagttaaactgaatagaaatgtttcttattttactttgggttaaagctgattgattaatgttagtttgaaagtcccatttcttcctttcagaagtaggactaatttggtttcaaaggtgaaagtagttctacattaagtctgttttgtaaactaattttggaataaatgcagtttaattact

SEQ ID NO: 359816 - DNA, 510 bp, Homo sapiens
ttttcagggttgccattcaatttatttaaaaaaacaagaaactgtgaagaacaacaaaacaaggtatgcccatactccaaaggtacttttaagaaatgaatttttgaaaggatttgaaatcaaatgtgttaattttgactgctctttatggatttggcattttgtagttttgattatgacacaagttatacataagtttaggtgtcactggacttgctatgcatctttttttttgtttttttactaggtcttaacttgcagagtcagtttaatctggaaaatgtcactgttttcaatacaaatgagcaggaaagcaccctgggtcagaaggtgaggctgatttgaaatcttctcagataacatatttgcaagtttgttattaagatagtgggtccaggcacagtggctcacacttgtaatcctagcactttgggaggctgaggtgggcagatcgcttgagcctaggagttcaagaccagcctggacaacatggcaaatcctcattcctac

SEQ ID NO: 359817 - DNA, 779 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtaagtatggttctgttttgttttgtttaaagtaatcttggacatgacatgctttatttaaaacgtcttctccccatacttctccacctatctgattttgtttattcttcaagttctgcctgactcccaactttgccaagaagtcccagttgaattagttcactcttatttctcatctctattatgcagtgcacattttggcacttcctttgttctccagttgttttgttcattcagtaaattttcattgagcatctactatgtgcctggtactgagctaggacctggagattcaatggtgaataaagcatattcccctgcttatgtggagctaatggaagaaacagatgtatgcatgccttactatggtgtaagtactatggtcgaagtgggaatgaagtgtagttagagggaatagagccaacatggctctctaaacttcagtctaaaggagtcaggagaggttttagaaaagaacatgagaactagaa

SEQ ID NO: 359818 - DNA, 3941 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359819 - DNA, 4188 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaagtaagttcaacacgcaacaaacccatgattgaaaaaatggaaatttaggattttctttgtttcagccccaaataggaaaataaggataaagttaagctcaggtacaagaccacaaacactccttggttctctgcctacaaaccactcctatgatgcagaaagttgttgaaagcttagtatattctttctaatcacagctactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359820 - DNA, 3790 bp, Homo sapiens
taagaccattcgagagaattatttttcataggctattctactctacagttttttaaacttttaaattggcttgtgctccacttgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359821 - DNA, 3454 bp, Homo sapiens
aaatttagagtcttgctatgttgctcagactgatctcgaactcctgagctcaagtgatcctccttctcagcttcctgagtagctgggactataataggctttgtgccaccatgcccagcttacttttttctatttctgctttattttatcctcatgtctggaccatagatagatcattgttatccaccagcaagaatgtgtcatggcataaaacagtcaagaaatctaagtgaaaccttgactgggctgtctttgggcttgtgcggtaatgcctcacatgcagtgaactctcaacaaatggcttttaaattgaattggaatcttccatttctatattagcacattttgtacctttaggaaaaacttgattttaatgtgttgttttcgtatgtgtttgcttgtttcttgagtagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359822 - DNA, 3248 bp, Homo sapiens
ccaacagctccagttacaacagctccagttacaacagctccagttacaacagctccagttacaacagctccagttacaacagcttctcaaggggcaggtcaaattcaaaagttcaaactatgttttaactgatgagcaatcactttggattgaagatactacaaaatcagtttatcaagtaagttcaacacgcaacaaacccatgattgaaaaaatggaaatttaggattttctttgtttcagccccaaataggaaaataaggataaagttaagctcaggtacaagaccacaaacactccttggttctctgcctacaaaccactcctatgatgcagaaagttgttgaaagcttagtatattctttctaatcacagctactatctgaaaacccccccgatggagaaagattttcaaagatggtagagcatatattaaacactgaagaaaactggaactcgtggaaaaatgaaggttgcccaagttttgtgaaagaaagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359823 - DNA, 2686 bp, Homo sapiens
  misc_feature (31)..(31): n is a, c, g, or t
cggcgcactagaggatcccctcggtctaccntgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccgcctccttctgaagaaataaaaacaggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359824 - DNA, 2552 bp, Homo sapiens
  misc_feature (16)..(16): n is a, c, g, or t
  misc_feature (19)..(19): n is a, c, g, or t
  misc_feature (26)..(26): n is a, c, g, or t
  misc_feature (36)..(36): n is a, c, g, or t
  misc_feature (43)..(43): n is a, c, g, or t
  misc_feature (49)..(50): n is a, c, g, or t
  misc_feature (54)..(55): n is a, c, g, or t
  misc_feature (58)..(60): n is a, c, g, or t
  misc_feature (77)..(77): n is a, c, g, or t
  misc_feature (80)..(80): n is a, c, g, or t
cgactctagaggatcncgnatatgcngtctcatgtnataagtnagactnnctgnnagnnncttaatccagacttatncantgcattaatcagattctcaggtgtgcatgaactccctcttgatcttgccaggcaaccaggagctgcttagctctcatcttcatgtcttcactgtcacactcaatctgccgtaatttctgagtctgtcatttccaagataggtgaggatgaagatgaggaagataatgatgctctactgaaggaaaatgaaagtcctgatgttcggcgagacaaacctgtaacaggagaacaaatagaggtatttgccaacaagctgggtgaacaatggaagattctggctccctacttggaaatgaaagactcagaaattaggcagattgagtgtgacagtgaagacatgaagatgagagctaagcagctcctggttgcctggcaagatcaagagggagttcatgcaacacctgagaatctgattaatgcactgaataagtctggattaagtgaccttgcagaaagtctaactaatgacaatgagacaaatagttagcttcttttttttttctttttattaaaactgtgatagattttgttaccaagcagcatttgataagaggtccactggttttggtaaacaataaacatttttataacaattgttgtacagtcggctggtgctctgagaacaatagaacacatattggctcaaaccagagtttggggaggttgggttgagataatgacctaaacgaagtgacctcaagatcacaaaatatatttttttgttaagtagatgtatttataatgaagttaaataagcactatttagggatatgtcgtttcttataccaaattagtttcctgtgtgttgtttgttagtagttttacaaaatttatcctgaaatcccagaataacactttctgaaaccatatgactgctctgttctcacttattcgtgctttcaagcagaggatcaacaaatgatggtttgttctgcctgccacgagtcttgatcattaaaattgtactggcacccagctgtgctcactcataactaactaactaactgtctatggctccagctacactataacaacagcaaagctaaggagctgcagcactttatagcctgcaaagcctgaaataatttactatcaatcatcaatcaatcatcatctatctatctatctatctatctaatctatctatcttgtccattacagaaaatgtttgtttgccaactttaaaagaaatgaagtctaaaacctcacttttccttctagccttacaaaaattgcctgacctctcaagacttttaatcacttcagggattcttgtgacattcaactgagatatatgtgaacacaccctatacacagcaaagcactaagtagtagtagcagaagacagtaccaccgacttttcttgttcccacataagcatttccctttagggctctaagatgaggtcatcatcgtttttaatcctgaagaagggctactgagtgagtgcagattattcggtaaacactcttaggcctaacctagctagtcagtcaagcagtaatctagcacaactctaatgttgagatgatggcctcggtgtgagtggcacagcatataaggcacattcaggaatcaagacttttttttttttggcctactcctctcccttctcaaagaccttacaggcaaggctgaattctaaaatagccttattagttaaaaacaacactggtataactaactcccatttctacttgaaaaaattctttggaataatgcttttttagatcaaataaaaaaatcaagctttttataatgatgataaggaattaattacaatttttaaaattctaatatagtccatacaaggcttatatactttgctctaaacctagctcacctggtctagtagctacaacatttagtagctacagtcagaaaatctaaattctaattgttaaattcatgtcctcaataaaattgttctgaccaaatgagacaatgaataaaaaagactttgcaaagttacaagcatcatacaaatatacatgaatcattataattttcatggtctcatcctgcccattctattcttaatcccctccacaaagtagaaagtattgattgccaagtcaaagtttaggtgaggaagctatttacaaataagtttccctgcaatgcttaatcccctcctagtgttcacagattgcatcacatcagatttgaaagtaaaatggctgttattttctatttttaatagttatcatcagtgttgtgctctgccgagcattaaaacaacatacacaaagatatgagatgttatgataatccccaaactttattataaataactcaaaatcagagccaaactggctggtattctatgctttatcctttccctagcatcagtcaagggtcctggaacaaagatgagtaactattaaaatgtaagaagcctatcatattgaaatacctcatatgcttggtattttctactatcactttaaaatcactaaaattctgaaacag

SEQ ID NO: 359825 - DNA, 2070 bp, Homo sapiens
agcggcagtggcgggcacgcgcagccgagaagatgtctccgacgccgccgctcttcagtttgcccgaagcgcggacgcggtttacgaagtctaccagagaggccttgaacaacaaaaacatcaagccattgttaagtaccttcagccaggtacctggcagtgaaaatgaaaaaaaatgtacccttgaccaagctttcagaggtattctagaagaagaaattataaatcattcatcatgtgaaaacgttttagctattatttctcttgctattgggggagtaactgaaggtatttgtaccgcatctacaccttttgtattgttgggagatgttttggattgtcttcctttggatcagtgtgacacaatattcacttttgtggaaaaaaatgttgctacttggaaatcaaatacattctattctgctgggaaaaattacttactacgtatgtgcaatgatctcctaagaagattgtctaaatcccagaatacagtcttctgtggacggattcagctctttttggccaggcttttccctctgtctgagaaatcaggtcttaacttgcagagtcagtttaatctggaaaatgtcactgttttcaatacaaatgagcaggaaagcaccctgggtcagaagcacactgaagatagagaagaaggaatggatgtagaagaaggcgaaatgggagatgaggaagctccaacaacgtgctctattccaattgattacaacctgtatcgaaaattctggtcacttcaggattacttcaggaaccctgtgcaatgctatgagaagatttcatggaaaacttttctcaagtattctgaagaagttttagctgtttttaagagttataaattagatgatactcaggcctcaagaaaaaagatggaagaattgaaaacaggaggagaacatgtatattttgcaaaatttttaacaagtgaaaagctgatggatttacaactgagtgacagtaactttcgtcgacacatcctgttgcagtatctcattttattccaatatctcaaggggcaggtcaaattcaaaagttcaaactatgttttaactgatgagcaatcactttggattgaagatactacaaaatcagtttatcaactactatctgaaaacccccccgatggagaaagattttcaaagatggtagagcatatattaaacactgaagaaaactggaactcgtggaaaaatgaaggttgcccaagttttgtgaaagaaagtgtatgttttgttcaccacagaacatcagataccaaacctacgagaataattcggaagagaacagcacccgaggacttcctagggaaaggacccaccaaaaaaattctgatgggaaatgaggagttaacaaggctttggaatctttgccctgataatatggaagcctgtaaatcagagacaagggaacacatgcccactttggaggaattctttgaagaagccattgaacaggcagaccctgaaaatatggtggaaaatgaatataaggctgtgaacaattcaaattatggttggagagccctgagactattagcacggagaagccctcacttcttccagccaaccaaccagcagtttaaaagtttaccagaatatcttgaaaatatggtaataaagctagccaaggaattaccggtaagtaccatagatcaacttttcataccctttagttgacatcttctttaaaattgctgtcactatgtgagcaaaaaactgacttaatcatgtgaaaaaccagtgatccacaagctcccatgttttagaatgagggaaaaacacattggaatatacatttacaggaaatacatgagttgataaagaagtaactgataattttctgtacagcatgtaatttaaagttcaacagggctgtgggtgcggtggctcacgactgtaatcccagcactttgggaggccgaggcgggtggatcatgaggtcaagagattgagaccatcctggccaatatggtgaaaccccgtctctactaaaatataaaaaattagccaggtgtggtggcacgtgcctgtagtcccagctactcaagaggct

SEQ ID NO: 359826 - DNA, 317 bp, Homo sapiens
aagtaaacatggtcttgttcacgtcattcctagatccctaaatgaggaggggaaaggaagggtgggggaagaggtttgaatcttaaaaagaggcaattatgtaacaattatgtaacatttaaaatatttaataatttttttttttttttttttgtgacagagtgaaactccatctcaaaaggaaaaaaaagaaagtttcatgaggccataactttatctattttgttccttggtgtattactagcacctggtatttagtagtttctgaaatatttattgaatgaatgaataagtgtgcaagatcagaattgccattg

SEQ ID NO: 359827 - DNA, 264 bp, Homo sapiens
ccctgtgctgtgttcagaaaatgccccaaacacctccgggcagagagccagggtgaagctggaactccctcatgtgtgtccttctctagggtcacagccctgccatggcacctatgcttaaaaacagttgcttcatataatttgtctagttttctagttgtttatgggggaaaggtaagtctgctatctgtcaccgtcttatggccggacccagcagtcccagcagagctgtgggaatttaaagttggtttcactcctcccacc

SEQ ID NO: 359828 - DNA, 404 bp, Homo sapiens
agctacaggatacataaaagtatgagaggagattatagagttgcaaaaggggtcatgacttttcttatccagaaagggtaggtgaaaatcactagggaagtctaaatttataaaactagaggcaagtttagtattttcattttagaagctgggaccagctatagataattgctccccagttctctgcttctccagtattcttgccctgccataatcaccatcatgattagcagtctgtcatagtatcctcaatagaatctttttgagatctatccccagcccatatttttacctggaactgacatcatgcaaattaagtatgacaacaacgttttaatgctttacttcccctgtcctgcaataaattataatgctaaattgtacacataacttttaaagtctgt

SEQ ID NO: 359829 - DNA, 5433 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359830 - DNA, 5094 bp, Homo sapiens
acttttctttgcctactcaacctgcaaggaagagatgtcaagtcatgttgaatcataacttctggttgcagttttctttgttttgtttgtttgtgtgtgtgtgtatttacttaaatggagctttttgtttctaatccaaatatttattttttctctgcagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359831 - DNA, 5387 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggatggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359832 - DNA, 3307 bp, Homo sapiens
gcacgagctcgtgccgtccacggcaagacaggtccgggacatgatgcagagatccaaaaataggccgaggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359833 - DNA, 1420 bp, Homo sapiens
cgccctgcctgaacttctatatgaagtttgttcttctatgacactatttctctttggtaagctagctgtttctatctacaaagacacagtgagtacaggattagaagtgagctctcagccaaattccttatgcaagttctacctgttctgttaggcttcagggactcccagggtttggtgctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359834 - DNA, 2645 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttggtaagagtttcatatgtctggggttgggatggctttgacagaggatggacccacatctgagtactgttagtcacattgttggaaacagaaatgtcctgaagaagccatttctgtaagtcttgtaatggtcaaggatgccatgcctagtggtgggaacagaacattgtcatttcctggagctttgctatctgccatctcttgattattttttaatataagtttgggctctgcctgcccccttagaattgatttttttggttgtttttttttgtcttttttttgagttggagtttcactcttttcgcccaggctggagtgctatggtgtgatctcagctcactgcaacctccgcctcttgggttcaagcaaattctcttgcctcagcctcccaagtagcttggactataggtgcctaccaccacgcct

SEQ ID NO: 359835 - DNA, 477 bp, Homo sapiens
cagaacttagattctcagccagattaatagcaaatctagacttcccaagggaatatgctagagaaaatgaccacagcgttccactgctagggaaagggtccctatgaacaagaccagggcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359836 - DNA, 1622 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggtaggggtagccttgtctctgtccacttcttcacaggtatacaacctg

SEQ ID NO: 359837 - DNA, 457 bp, Homo sapiens
tagtattatcatcttattattattactgccttatctgttgcagcagagtattgcctgtacagccacaattaggatatataaattaggacgcaagttagttggcaagggaactacatgaagccaacaaggatggctaatcttgctttcctttttcttgggattcagttgaaaggtcagattataatatactctgagcatcatattattggccacatagttatagattgtatggccagttggcttcattctgtctgatagcatcagtgcatccctaaccatttttttttgatgcatactagtagttataacaagaagtcagacctattgccaattctttaaataatggtcacagacacctgagagcccctaccagtagagtatagcatcatctttatataaccaggaacaatgcagtcatcattttctcatagaacccacttaacctgtgtgtgaagat

SEQ ID NO: 359838 - DNA, 794 bp, Homo sapiens
gattatagagttgcaaaaggggtcatgacttttcttatccagaaagggtaggtgaaaatcactagggaagtctaaatttataaaactagaggcaagtttagtattttcattttagaagctgggaccagctatagataattgctccccagttctctgcttctccagtattcttgccctgccataatcaccatcatgattagcagtctgtcatagtatcctcaatagaatctttttgagatctatccccagcccatatttttacctggaactgacatcatgcaaattaagtatgacaacaacgttttaatgctttacttcccctgtcctgcaataaattataatgctaaattgtacacataacttttaaagtctgttaaaaggaaaaaataagaggagtcagtctgtgcccctctaggaagttttccttctaggcttacagatctaggtgtggattcatttgctgccaggcaagaggaaaagcacgatacctctgttactgtgtttaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggtaagatagagttcagtgggacttttccagcaagactttcttagactcataattacgttgaggagaagaatataagaagagacatatacagtgataaaaactttaaatga

SEQ ID NO: 359839 - DNA, 617 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggtagcggccctcggcgccggccgccctgtctggcgctgtcgggtcgccccgagtccctccttctcggccccgctttcccagcgtcgtgagcttagtgctttaggcgcccacggggtatatgtcttagggtcttcaccactcttcccactcaccggcactagaaattggctagatcattggtttgactagtcatttttgattgtcctaagtcacctaaccgtctcttgagctttagtttccccatctgtaaaatgggcttactgataataccttgaaatcatctttttctttttttttaagattatcttgagaatcaaacgaaggctctgttctgtaaattaaagtggtatac

SEQ ID NO: 359840 - DNA, 5255 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359841 - DNA, 4988 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggatataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359842 - DNA, 5379 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccgcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatcag

SEQ ID NO: 359843 - DNA, 4587 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatgataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttgagaaagtattgaattctaagaccatccgttccaatagcagtggcttatccattggaactgtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcgtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtggggatgcattccaaaggaactcagacagcaaaggaagagatggaaatggatccaaagcctgacttagattcagattcctggtgcctcctgggaacagactcctgtagacccagcctctagtctcctgagcctatagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccccaaatctgttcaatgggatcttccttgccttgatgttccaacggttctcccgttcttgcaaccctatcccatacacctaccgcatccccgaccctcttttgac

SEQ ID NO: 359844 - DNA, 2066 bp, Homo sapiens
cctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggatgactcactggttgtgtggaaggaagtcgatttgacccggctgtctgagaaggaacgtcgtgatgccttgaatgagatagttattctggcactgctgcagcacgacaacattattgcctactacaatcacttcatggacaataccacgctgctgattgagctggaatattgtaatggagggaacctgtatgacaaaatccttcgtcagaaggacaagttgtttgaggaagagatggtggtgtggtacctatttcagattgtttcagcagtgagctgcatccataaagctggaatccttcatagagatataaagacattaaatatttttctgaccaaggcaaacctgataaaacttggagattatggcctagcaaagaaacttaattctgagtattccatggctgagacgcttgtgggaaccccatattacatgtctccagagctctgtcaaggagtaaagtacaatttcaagtctgatatctgggcagttggctgcgtcatttttgaactgcttaccttaaagaggacgtttgatgctacaaacccacttaacctgtgtgtgaagatcgtgcaaggaattcgggccatggaagttgactctagccagtactctttggaattgatccaaatggttcattcgtgccttgaccaggatcctgagcagagacctactgcagatgaacttctagatcgccctcttctcaggaaacgcaggagagagatggaggaaaaagtcactctgcttaatgcacctacaaagagaccaaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtgaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactgatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggacgactgggtttggattcagaagaggattattatacaccacaaaaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagcataccatgaagttccctacacaacgtcctttaccttggccaaacagttgtccttttataagatccgtaccattgccccaggcaagactcacacagctgctattgatgagcgaggccggctgctgacctttggctgcaacaagtgtgggcagctgggcgttgggaactacaagaagcgtctgggaatcaacctgttggggggaccccttggtgggaagcaagtgatcagggtctcctgcagcatggtaactcatcacgtcgagcgccgaatttagtagtagtagtagt

SEQ ID NO: 359845 - DNA, 3629 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359846 - DNA, 1436 bp, Homo sapiens
atgggaccccggcaggacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctcc

SEQ ID NO: 359847 - DNA, 4248 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcgaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359848 - DNA, 4072 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtgaaaaaaaaaaaaaaaaaaaaaaaaaaaaaaaaaaaaaaaaaaaaaaaaaaaaaaaaaaaaaaaaagggggggggggaaaaaataaccccccggggggccccttttccgccccgttttttgtgacaggggcgcccccaaagagagcgcgtaaaaaaagcaaggcggggcgcggtgaaaacaccggccgtggcgggaccccggcctctggcactccggggaagagccccctcgtcggggggggacttcggcccccccccacaggagtacgccgaggcaataaccttcacgggtactgggacgcagcgatttcgcgcgcggacgtcgtccgattgtagatacgccatgaacaaatactcaccgccatagacccaacaccagagtccacacgtgcatacccgctcccaccacacgcacaacgctcacagatcagtagacggccacgc

SEQ ID NO: 359849 - DNA, 2446 bp, Homo sapiens
  misc_feature (7)..(7): n is a, c, g, or t
aaactanggctaggtacgaggctgggtgtaatcggccgagtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359850 - DNA, 3550 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctccctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359851 - DNA, 3484 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359852 - DNA, 2947 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagaaagaccccccttgctggcgcccaactcgggcccaacgaattatcgcgcccaagccgagccaatcccttgctcgactagggcctcgaggggcgtggctgtgcctctccgcgcggggggccttcaacggcaccccggtgggcccgcaaggaacgctttcaaggtggcgtctgggggggcccttcgcgccggcccccttattgcttggggacccaaggggctcccccaaggttggtggcaaggccc

SEQ ID NO: 359853 - DNA, 2674 bp, Homo sapiens
gctaggtcgagcctggtttaaatcggacgagggggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359854 - DNA, 2646 bp, Homo sapiens
tctctagctgttctagagtatcccagtgcacggaatcgcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359855 - DNA, 2785 bp, Homo sapiens
atgggaccccggcaggacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359856 - DNA, 2615 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagacccactccacagcgccgacacggtgtccagccatacacccgccctgggacggccagcagaaagacgaggggaacacaaatcacaggggcacccaccatgataaccaagagcacagaaggaggagaaagcaagaccgacactgatctccggaagacacaacaaa

SEQ ID NO: 359857 - DNA, 2330 bp, Homo sapiens
gcggcgctactactactatataattcgcgccgtcgacggtcaatcaagactccagaccttggggacagcggccctgcctgtgactggcacattgggctgcgtggctgtgctctgttgtcccaggctctgttgcctatgagggtgtggggagtgcgacgccagcccctgttctcctgtctgggaagcctcctggttcccacgccttccctgctggcaaggccaggaaatgctcttgccgctgcccccccttgccaggcttggccttgtactcacagtgacccccgctctcccccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359858 - DNA, 3333 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaagaaaagtctggaaagtagcagaatcatctcaaggtgtcaaa

SEQ ID NO: 359859 - DNA, 2336 bp, Homo sapiens
gggagggcccctgggctcacacctttgaccctagccctctgtgtggatgctacccttggaaccttatctcacgcaaacaagtgcagttcctcagatgtcacatttcatgtgccacagccccacacacaagccccagggactcctcccatgggcccctttccatcaggcctctgtgagtctataccccatcagcccctggcccagtgagtctgtctgtccgcccacctgcccaggtggcgcctcatgttggtttcctgctggaaatgcttgggacagggtggaactgggtttcctgggctttggggctggaggtgtctctattgcggtccctggcttcccactgagctgtgggcaaggctgctgcgctgggggatggctggggcacggagcgaggttccctgctaagctgcgcgctttcccccaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359860 - DNA, 1937 bp, Homo sapiens
tccggacttgggctgtagcgatctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359861 - DNA, 3272 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccgcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359862 - DNA, 3328 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcaggtgagcagggcccaccccaatgcccagccaacccgggaggccgccctcgccgcaggcctggcccctctgcctccagccctgacgtctccctctctggacacagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359863 - DNA, 3179 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359864 - DNA, 2869 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359865 - DNA, 2429 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagga

SEQ ID NO: 359866 - DNA, 2146 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359867 - DNA, 2215 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359868 - DNA, 1701 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcacaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359869 - DNA, 2208 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcgaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaaggtattgctccctcggcagggtgactcctgaccttgtggaaacgggggtacgggggtttggtatcaggctcccagcgcctcat

SEQ ID NO: 359870 - DNA, 1671 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgggcattggcaaacccgatgaagtcctctggttcgtgttgatgtaggactgctcaatgtcgatggt

SEQ ID NO: 359871 - DNA, 2099 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcacaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtgaaaaaaaaaaaaaaaaaaaagggggggggggaaaaaataaccccccggggggccccttttccgccccgttttttgtgacaggggcgcccccaaagagagcgcgtaaaaaaagcaaggcggggcgcggtgaaaacaccggccgtggcgggaccccggcctctggcactccggggaagagccccctcgtcggggggggacttcggcccccccccacaggagtacgccgaggcaataaccttcacgggtactgggacgcagcgatttcgcgcgcggacgtcgtccgattgtagatacgccatgaacaaatactcaccgccatagacccaacaccagagtccacacgtgcatacccgctcccaccacacgcacaacgctcacagatcagtagacggccacgc

SEQ ID NO: 359872 - DNA, 1296 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggagacctcacccactcctcgctcagtttgaccactgtaagtgcctgcactctgtattctattaataaactaaaataaagggaagacgctgctggtg

SEQ ID NO: 359873 - DNA, 1064 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggtaaccctgagcctagggcagtcccctcttccaggtgcctctgagcatgggatgtgcccagcatccttggttccaagtcactggcgttctctttaatccatggccgctgtaggaaaaggcctcctggaacatggcacttcctccgagaaccagcagtgctggtgggcatcccctgggaagtcactgtgtggcagttggacggtcctccttggacatggcagtgcccatgttgccagagtgggaagctagcctagggctgaaggaagggcccagcgctccatcgcccagatgcgatcttaggtc

SEQ ID NO: 359874 - DNA, 142 bp, Homo sapiens
catagccagcccccacctcaggttctggcagccacagtggcatggcgggggctcctactccatctgtatctgtagctcacaccctctccttcctcacagccccactccacagcgccgaccggtgtccagcatacacccccct

SEQ ID NO: 359875 - DNA, 563 bp, Homo sapiens
ctcctgtttttcctttgaccactctttcctctggattcctgggccttcccacttaccccagctgttactatactgagcagctggtgacctggtgggtattgcctgctgtgtgcctttgccctggtgtgtgaacggggtacgccctggctgggtggccccagccctgggtgggacatccctggggcccgctgaagagctacggggtgctctctcagagccagggccagtgctgggcctctgggccaggaccttgaccgcaccagctgtagcccctgctgtttcagagcctgcaggctggggaggtggagtccttaaacaaattgtcacaaggatgatgagagtaggaagagagggtaggggatagactatgggaaaggggagctgggaatgtggcctggagagatcttcctgaagaagtcaggtgatgccagggggacccagagaattggacccagggaaggaaggctaccagaccaggcaggtagaggtaagagagccagcggccaggccccatcgccaggagggccctgcaggtccaggggaggattttggattttccccca

SEQ ID NO: 359876 - DNA, 369 bp, Homo sapiens
gcttgcagctgccagctgatgctctttcctggtggcagcctctgacctctgacctctgggctctttcaggcctacggaccatcggtgtcatcaccaagcttgacctgatggacgagggcaccgacgccagggacgtcttggagaacaagttgctcccgttgagaagaggtgtggctttgggggtgctggggaagcaggaggatgggtggggtccttatcattactgaaaccccagcacctgttccctgcctgcctggaagtcattgcttctccatttcaccgtaactccttctttcttttccctttgagctatgtatctttttcttctgatttgtatgcattcgtttttcaagtgcacaattaacacct

SEQ ID NO: 359877 - DNA, 1005 bp, Homo sapiens
attaaaaatacaaaaccaggcaattgacagtgtcatgactattgggatgttacagggaagttttttgtaaaacaacctgtttaccagatgagcattgtaagttactggaggttgcagtgagccgagatcacgccactgcgttccagtctgggcaacagagtgagactccgtcacacaaaaaaaaaaaaagagaaaaaataaataacataaaactgaagtattaagggagtgatgctacctcaggggcctgtggcaagttaataaaaccaggtggtaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaacagaagcaaagacaaaacaaaaaaaaaaaagaaaaacagaaaaaaaaaataaaaaagaaaaacagagccgcgggggggaacacgaacgcacattattcatgcagcgagagccggcacacgacgacgccgcccacccgccgccgacgcaaccgacgccgaaggcccagcgcagaaatgagaccattcatgacaccacagccgccgctacatacggatgtcaacaacaactagcgagcgacgcgcacccgcaaggggtacactcacgtgccgaacaccacacatacaatacagctggaagaaaaaagtcgaaacacaccaccacacccaatgccaaaacagacagaacataagaataatactcacatagtcggtgacgcgaagaagaaacaaacccagccatctaatgcagcgaaaacagtaaccagatacgcgcgatgcaattaacaaaaaattataatcgcgacggagagaatttaaaagacaaacacgaaacaccaaccaagaaagagacgaaccgacgacagaaccacaacccacaacaagatttcgcgagcgtaccaccaacgaagcctacccacaaacaccacatcgacccacaacacaagatcaccg

SEQ ID NO: 359878 - DNA, 3614 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatgggttgacgagaggacttcgacggggatcagttgccatgaagaacatccacgaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359879 - DNA, 3629 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359880 - DNA, 3024 bp, Homo sapiens
aagatcatgtctgatgtacgatgagcggtgttatcgtgcgaggacagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatgggttgacgagaggacttcgacggggatcagttgccatgaagaacatccacgaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359881 - DNA, 2223 bp, Homo sapiens
gctggtacggctcggagtacgggatcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359882 - DNA, 2334 bp, Homo sapiens
ctggggaagagggatgggggggcccaccgaccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359883 - DNA, 3294 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359884 - DNA, 2360 bp, Homo sapiens
gcggcgctactactactatataattcgcgccgtcgacggtcaatcaagactccagaccttggggacagcggccctgcctgtgactggcacattgggctgcgtggctgtgctctgttgtcccaggctctgttgcctatgagggtgtggggagtgcgacgccagcccctgttctcctgtctgggaagcctcctggttcccacgccttccctgctggcaaggccaggaaatgctcttgccgctgcccccccttgccaggcttggccttgtactcacagtgacccccgctctcccccagattcttctgctgatcgacattgagcagtcctacatcaacacgaaccatgaggacttcatcgggtttgccaactgttactatactgagcagctggtgacctgtgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359885 - DNA, 3762 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaagaaaaaaaaaaaaaaaaaaaaaaaaaaaaaaaaaaaaaaaaaaaaaaaaaaaaaaaaaaaaaaaaaaaaaaaaacggaagagaaaaaaaaaaaaagccagccataagaagaagcaaataacacaaacagagacaaaagaatacaaacaacacaaagcgaagcaccagggacgcgcaacacaaaaaggcagcagcaagaaacaaagagagagcgagggcagacgaaccgaccgacaacacaacgacgcggagcgaggcagccgacaggacggagagaaaaagaacaacaggcacggcgacacacagacagacagcgggggcacaacgacaccacgcgaagcacgaagcccgtaataggaaacagcgaacccgagcctaacaagaagaccaaagaagaacgagcgaggaacgacacggagaagcgaagacagaaggcgaagaaacccaagaacgacgcgcagacgccagccc

SEQ ID NO: 359886 - DNA, 3225 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359887 - DNA, 1837 bp, Homo sapiens
  misc_feature (7)..(7): n is a, c, g, or t
aaactanggctaggtacgaggctgggtgtaatcggccgagagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359888 - DNA, 2662 bp, Homo sapiens
gcagcactagtgttgttgttgtttttaagagacagggtctccctgtgtttcccaggcttgattcacactctcgggcttaagcgatcctcctgcctcagcctcctgagtagctggagttacaggcatacaattccacacccagctagcacctagttctttaacttgcttttttggttaacttgcttaatgatttagcttggagatctttcctcatctgttcataaagagcctcttcattctttctcacgtccgcatggtctttgatgggagagccatcactggtttaattagatggtttccagtgtgtcgctaccacggacaatctaattatacatgtaagtttgttgatgtgttcatgtatctggaggttaaactcctgtagtgccaaatcttttatgtggataaacacttgtcatttggagagctgtcacctgattgccctcggtggcgttgtgccggtcccctcctcacggcgtgtctgggaagagcaagctcgttttagctgcacagcctagaagccgtgggcagacctgggggaaggggcagggctctcccctcccatgctggccctggcgtcagatgccacgtcacacctgtggtctctcccaggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359889 - DNA, 2161 bp, Homo sapiens
gcttacctctgcagagcgaatggtgtaatcagcgccggtggcatgggataaacataacactctaggtcaaacaacagcgcagacaggtggaacccagtgcactcaactagacctctcgtcgtccctcgctcccctcttctctctcggcagcgcctgtctggcttccccagcagccactgccctttgccttccaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359890 - DNA, 2112 bp, Homo sapiens
  misc_feature (7)..(7): n is a, c, g, or t
aaactanggctaggtacgaggctgggtgtaatcggccgagggacttcttagaagtcaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359891 - DNA, 2047 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacattccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaaga

SEQ ID NO: 359892 - DNA, 1145 bp, Homo sapiens
gcccagggagggcagggggctcactgagggtcaaacagcaggcgagttgatgcctaggtttggcactcctgcccgacaccctggtggcttgcggaggtcagcctgggaacaccctggggtggtgtgtgggtgggggctgggtcctcaacccaggcctgcctcttgctcccggcctcactgccgtctccccctccccacctgtctttattctctttgcagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359893 - DNA, 2280 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctcc

SEQ ID NO: 359894 - DNA, 1390 bp, Homo sapiens
tgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcatcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtg

SEQ ID NO: 359895 - DNA, 1473 bp, Homo sapiens
ggcctcggcctgcacggcggctgcggcggcggtagcggcagcggcggcggcggcggcggcggcggcggcggcggcggcggcggcggcggcagcggcggcggcctgggcccgggcgcacggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggtgagtagggcctccagggtactgctgcagtgatcacttgccattgctgtgcagctgtgcagccctcaggaagctacagcccctctctgagccctctcctctgccctgcacagcgctctcacagagatttgggccaaaagtgtcaatgcatgtagacacttagcacacagcacacatgcaatacatgtggaacattattaggtgaggctaaggcagagggggcatttaggctcaggagttcaagatcagcctgggcaacacagagacgccatcgctatttttaaaattaaaataaataaat

SEQ ID NO: 359896 - DNA, 620 bp, Homo sapiens
ctggggaagagggatgggggggcccaccgaccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaaagtaggtacttttagagactggctggtcgggcggcaccaatcctcactctcagatccaaggaggtgactgagttgggattctctgagagggcaggtgtcagacagtctctgtcgggggtcctggggtgaaggcagagccaactgagaatatctggaagctctcctgggctgatagtggtccactgtccccaaccaacacgccttctgtgaggcatccccatggttagtttagggagagggcagtgctatg

SEQ ID NO: 359897 - DNA, 4994 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcggagtgatgggatcagagtccccgggggtccaggggtcccggcgcggagaggatgccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359898 - DNA, 4919 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359899 - DNA, 4863 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggtgagcgtcgggggagtccccgtccttccgcctccgccatccccttcccttcccgaggccccgccccttcccgagcccgcgcctttcagcccctctccccgcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359900 - DNA, 5076 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggtgcgtggggagggttgggcgttcctgaccccgactgggaggtcagcccgagagactttgggtccctgggggtgcgacggtgccccactaccagcaccggccccagggtgccccaccgctgtgggctgccaccctcacgcgtacccccacataccaggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359901 - DNA, 5713 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcaggtacggggcgccacggatcagtcattgatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359902 - DNA, 6016 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcaggtacggggcgccacggatcagtcattgatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacaggtgacctgactccatggcctgcttctgcatgttcacaggctcctgacctccaaactcaagtcaagggcctctcgttaggagttacccgtcacctgaccgtgtgcccccctacccccatcacaagatgcctgaccaccaccatgtggggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359903 - DNA, 5179 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaaaaaaaaataaaaaaagaaaaaaaaagagggcgggcaggcaagaaaatttcccgtggaggggcccaaagcgaaagccgtacccgggttttctggatcaaaaggggccctatttcgggggagggtcgcagataatagagttcagtgccttggggcccatcatcttgcaggacttgcgtagtcggagccaaggtgctcacgttggccgtgctcttgcgaaggaaacgctgattccccggggggcgtccccgtctttggcgcacccatctaaccctagcaggagattaggagcctcccaggtgtgaaatttaggattccaaagtctgttctactcgtggtaaaaggcagccggctaatgcagtagcccgcttgaaaatttggctactacgggcatggttatgggaaggttttttttcccggggc

SEQ ID NO: 359904 - DNA, 4803 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359905 - DNA, 4639 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359906 - DNA, 3367 bp, Homo sapiens
cacagttctccccaccccgttccccagcacagcgcttggggcccctctggctccagaccaggccccttggagcaggaaaaagatccactgatggaattcagacccctttccccttgggtccccagacagctcccccaagggaggagctgaggacttccctccctctgccccaagccttgtttccccaaggacaggtaccaacctcctcccctactgacacttctcaaccaagaaaacttcctttccattccctcaccagctgggcacccctatagctgcttaaatactttccaaatccagctgcactcctagccagggaaggtgaagggatgcacagaggtgggggaggggtactgtgcagggtactcagcatccctgaccaccaggtgccaatgatcagcggacgtggtctggggcacacaggaggcaccttggataagctggagtctattcctggattcaatgtcatccagagcccagagcaggtacggggcgccacggatcagtcattgatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359907 - DNA, 4311 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359908 - DNA, 3974 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaaaaataaaaaaaaaaaaaaaaaaaaaacaaaaaaacaaaaaaaaaaaaaaaaatacaacaaaaagcaaaaaaaaaaaaaaacaaaacacaaaacaaaaaaaaaagggggcgcccccagctacacacacacagagggcgacaagacagcatccaacagcctatgtttcatgaaaacagagaggcgtcccacacttcgtagaagagagctgggattaacattctgtgtgcgtctagcctctagtcgtatgctcaacttaaccaaccacgcaccttgggtcacagaactatactcgtcccgacgtgtcgcccaccgcctcgagccgataccacatacatgtgtgcgcgtggctac

SEQ ID NO: 359909 - DNA, 2705 bp, Homo sapiens
ctagcatttaacctacggcccgatccgagctgaggcgaggtacttgggctggatccgagacgatcggggatcgtagcgctatccgtcggcccgaacgatgagaatttcattgatgccgtgtagacttgaggtccctgcctggcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359910 - DNA, 2564 bp, Homo sapiens
gttggaagactaccttaacccccgaagcccaagtctacccagagccccaattgttcccaccgcactcccccccgggccaccaagggaaactttttccccgaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacaggtgacctgactccatggcctgcttctgcatgttcacaggctcctgacctccaaactcaagtcaagggcctctcgttaggagttacccgtcacctgaccgtgtgcccccctacccccatcacaagatgcctgaccaccaccatgtggggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359911 - DNA, 2679 bp, Homo sapiens
gaccagcctggccaacatagcgaaacccggtctctactaaaaatacaaaaactagctgggcgttgtggcatgtgcttgtaatcccagctactagggaggctgaggcaggagaatcacttgaacctgggaggcggaggttgcagtgagccgagatcgtgccactgcactccagcctgggcaacagagcaagactccgtctcaaaaaaaaaaaaaaaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacaggtgacctgactccatggcctgcttctgcatgttcacaggctcctgacctccaaactcaagtcaagggcctctcgttaggagttacccgtcacctgaccgtgtgcccccctacccccatcacaagatgcctgaccaccaccatgtggggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359912 - DNA, 3833 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaaaaataaaaaaaaaaaaaaaaaaaaaacaaaaaaacaaaaaaaaaaaaaaaaatacaacaaaaagcaaaaaaaaaaaaaaacaaaacacaaaacaaaaaaaaaagggggcgcccccagctacacacacacagagggcgacaagacagcatccaacagcctatgtttcatgaaaacagagaggcgtcccacacttcgtagaagagagctgggattaacattctgtgtgcgtctagcctctagtcgtatgctcaacttaaccaaccacgcaccttgggtcacagaactatactcgtcccgacgtgtcgcccaccgcctcgagccgataccacatacatgtgtgcgcgtggctac

SEQ ID NO: 359913 - DNA, 4095 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcaggtacggggcgccacggatcagtcattgatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgccctgcaggaggcgctcgtactctccgaccgcgcgccattcgccgccccctcgcccttcgcagagctcgttctgccgccgcagcaataaagctcctttgccgcgaaa

SEQ ID NO: 359914 - DNA, 3434 bp, Homo sapiens
  misc_feature (3095)..(3096): n is a, c, g, or t
  misc_feature (3149)..(3149): n is a, c, g, or t
  misc_feature (3158)..(3158): n is a, c, g, or t
  misc_feature (3200)..(3200): n is a, c, g, or t
  misc_feature (3203)..(3203): n is a, c, g, or t
  misc_feature (3246)..(3246): n is a, c, g, or t
  misc_feature (3277)..(3277): n is a, c, g, or t
  misc_feature (3325)..(3325): n is a, c, g, or t
  misc_feature (3426)..(3426): n is a, c, g, or t
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcggagtgatgggatcagagtccccgggggtccaggggtcccggcgcggagaggatgccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaaggaggccgcagaccccggacgtgtcaggcatccccgcaggcccggagcgatggcagccttgatgaccccgggaaccggggccccacccgcgccatggtgacattctccgcgaggtaaggagagtcctacgtggcacttccgcgagcccgttcggccgagagaccacaaagcgagacgtccactggatgtcatgattccgtcgatgatagtcagagactgtgaggtccggcatgaatgcggaaggcggtacgatcacgtggtgctttcagtgggaccagtccgtgttgagtcgaattgggcgagctgtcgcgagggtcgtcgatcaacgatcgtgtgcgccattgctttgaatgtgctcactcgctgagctatactgggaggtccattggaatcctggcatgcgaggacacctcgggtttgcgatgatctccaatgtgctccgcttgggcgtctaggttctggggtacatagccagtcataggtacgttggcccagaaggcgcttgggacagccacagacagacattggtggaacaaaggccaattccaacaagggtgggctgttggtggttgaacaacgtgtccacgccatgggttcacctctgcaacccttgcaccttgtgctggtgcattgttgtgcttggcaaaggggtgccccaaatcgatacacgcgcgcacgggtgtgtcctgtgtgtgcaccatcatgggatgtgcaaccnnttgcgaattacaggccttgtgaagctcataactctcccgtgcgcagtttccanagttgctcnatctccccatgaagtccgccacgaaaggtaacggagttgctnaangttggcatggccgtgtgaaccacaatcgtcgggtgtcgtggcntggataatcagatgagcgttccacgaagctngaacgcaagccttgtgctctcacttgcggcgcaccgcgacatcccttnattattgccacgccaatggagcattgttggaccatgccacaccggttgggcacaaagccctggccaacctccagtcaacaggcctccagattcctccaagntacagaaa

SEQ ID NO: 359915 - DNA, 1582 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatgtcttcgaagcagaaatgccacgcgctctgcgttcgtagatgcagcaatttgagtaggtgactctgctgatgacccgcgcagccaagagagacggcacggctgtatggtccgcgagcctg

SEQ ID NO: 359916 - DNA, 426 bp, Homo sapiens
acctgaccgtgtgcccccctacccccatcacaagatgcctgaccaccaccatgtggggtggcctgatactcaacccaccaggtgctgccacccccataataagggacttgaccctcaatgctcagggcccctgaccccaaagtcggcatccccgaactctcccaagaagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggtgagcggtgtggcctttccctgggcaagcgtcttgatgcgggcccagcctacccttcacccctcccgtccccactgcctccctccactcagca

SEQ ID NO: 359917 - DNA, 4759 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359918 - DNA, 3407 bp, Homo sapiens
agggttgggcagctctggccctgttttgagtgaggcctgtgcaccagcaacccgccctgggccgtccgcgttttcacagcaacccgccctgggcccgtctgcgtttggcttatgctggggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359919 - DNA, 3622 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 359920 - DNA, 5226 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggtgcggacgccggggctgggaggggaggaggtagccctgaggactcgctggactccggggtagtttcccagctccggctactgcgcggggctggcggggcacaccccagggcgcgctggaggccggagcgaggctggggcgcccgtgggaggctcccagcaggcaccggtgttctcgcggccaagcacagttataacgcgctcgcgcggcgcttcgagtggtcctggaacctttctggccacgagggcgctggccttgctggggagggcacaaacccagaaccgcccgggcgggggtgcagtgagtcctcgggagggtgccctcagcaggagggggcagtgaccgggagtcctgagacctccacctagcaaaccttctgcgggggcccgtgggaaaggctcaaaggtcaccaacgcaaaggcagggcgtcggctgtgagcccggaggagctgctgggaagcctggatgagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359921 - DNA, 5757 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcaggtacggggcgccacggatcagtcattgatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacaaggcaaaaccccatctctacaaaatagttcgctgcgtgtggtggtgcacgcatgtggttccagctactcaggaggctgaggcaggaggatcacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacagaaaaaaaaaaaaaaaaaaaaaaagctgctaagtcatttaccataagtcactgagaacaggggatgtctgaccagatgcaagtgctgctggaccaggcgggctgctgtatcgtgggtcagagtgagcagctggttcctgcggacggaatcctatatgcagccagagatgtgacagccaccgtggacagcctgccactcatcacagctccaggttctccattgtctccaacctcctctgcctcccccaagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359922 - DNA, 3782 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggtacgggcggggctcaagtcgcgaggcggggaagcgggaggcagacacggacgagggcgacacagacacgggaccgaggggcggacaccggagagacacgggaaaggggtcgggacaggagcacgtggctcagacaccgacgccgggaggccgcagaccccggacgtgtcaggcatccccgcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 359923 - DNA, 4916 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggtgcgtggggagggttgggcgttcctgaccccgactgggaggtcagcccgagagactttgggtccctgggggtgcgacggtgccccactaccagcaccggccccagggtgccccaccgctgtgggctgccaccctcacgcgtacccccacataccaggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359924 - DNA, 4468 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcggagtgatgggatcagagtccccgggggtccaggggtcccggcgcggagaggatgccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaacagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359925 - DNA, 4170 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatgagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359926 - DNA, 2716 bp, Homo sapiens
tgtgggcttctactccccaggccttgtcctctcttcctgttgctgtcgtatacgaacctgaccttgcgattggcgggcacccgtgtcctagtgccctctccacgactgtgctcgtcttgtatgatcctcttgtcatccggagtctcgactctgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaaccttgtcagtgcttgggcgggagcggaaggatccagggctgcggaggcgggggccgtctcgatgaacacgtgacccccggcgggctccgccttccgcgcacgcgctgagagcctgtcagcggctgcgcccgtgtgcgcatgcgcagctccggggacgcctgcgccctgcctgtgagcgtgtggcgcccgctttccctgagccggcggggcagagcccagggagctggaggtcggcgcttcctctcgtgcttggtccactgacgcgcggccccgccgcgaggagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359927 - DNA, 3726 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggtgagcgtcgggggagtccccgtccttccgcctccgccatccccttcccttcccgaggccccgccccttcccgagcccgcgcctttcagcccctctccccgcaggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 359928 - DNA, 3879 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaaggtgggggaggggccggggcggacgcagggggtccctggtccgcggcagtggaggcggcagccagcaccctctgccctctcgcagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcaggtggcctggagcccagggtcaagggtcagagtcaggagagtggggagggcctgaggtcggagtgatgggatcagagtccccgggggtccaggggtcccggcgcggagaggatgccggccccgcgaggtcagcggtgtctccgggcccgcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaacagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatgagcatcagatccatgctgctgctgactcggagccccacagcttggcacaggctctctcagctcaagcctccggtcctccctgggaccctgggaggccaggccctgcatctgaggtcctggcttttgtcaaggcagggccctgcagagacaggtgggcagggccagccccagggccctgggcttcgaacccggctgctgatcacaggcctgttcggggctggactcggtggggcctggctggccctgagggctgagaaggagaggctgcagcagcaaaagcgaacagaagccctgcgccaggcagctgtgggccagggcgacttccacctgctggatcacagaggccgggctcgctgcaaggctgacttccggggccagtgggtgctgatgtactttggcttcactcactgccctgacatctgcccagacgagctggagaagctggtgcaggtggtgcggcagctggaagcagagcctggtttgcctccagtgcagcctgtcttcatcactgtggaccccgagcgggacgacgttgaagccatggcccgctacgtccaggacttccacccaagactgttgggtctgaccggctccaccaaacaggttgcccaggctagtcacagttaccgcgtgtactacaatgccggccccaaggatgaggaccaggactacatcgtggaccactccattgccatctacctgctcaaccctgacggcctcttcacggattactacggccggagcagatcggctgagcagatctcagacagtgtgcggcggcacatggcggctttccgcagtgtcctgtcttgagccactgcagtctgggccccatcattaaacgggctgcgtttaa

SEQ ID NO: 359929 - DNA, 2710 bp, Homo sapiens
aacagcacgaaaatctcctgcccccaccccacccccaggtgattcccttcaccaagtctgggtctagacttggcccccgcgagttcacgtccctgcctaatgcgcctggagtccgggtgatggccctggatccgctcccggccccaagctccacacagccgggaaggaagctcgcgtttgttttgctggcgccagggatacggtccaggccccgccccgccccgcgctgatcccagggtagtgggaaagtgcgctccccaagaatttgcggtgcaggggccgcggccaccgccttctgtccgcaggtgctgcgagccgtaagcgccccccacccgcgctatgggctcggacgcctgggtgggcctttggcggccacaccggccccgcggccccatcgcggcgcactacggaggccccgggcccaaatacaagctgccgcccaacaccggtagaaggggcaggccccgggattgaggggtgggacggcgcctgggggagggaaggggaagagaccagggaggcctgcgctcggggctgaaccgtgcctgctagaggggagagggggtctgtgccgggggagggtccgtgttgcagatggggcttggggctgggcccggccagacgctaactcggatgctcccaggctacgccctgcatgacccgtcgcggccgcgcgcccccgccttcaccttcggcgcgcgcttccccacgcagcagacgacgtgcggccccgggccaggccacctggtgcccgctcgcatgaccgtgcgcggcaccgacggcgcccccgcctactccatctacggccgcccacgccgctcagcgcccttcctcactccgggacctggtcaggacccccgggcccctggccaccccaacgccgaactgcctccagggaggcccacctgggaacccccgacctgaaccccgagtccccctcggataccctaacaccgcatattcggtacccccatatccggatctcaaatcccaaaccccgaaccccacggggctttgataaatcgtggctcagactccccactagtcccaggaccccatctcgggtacccaccaggctcccacgcagttctagccccccacacccttgatccgccccgcaggcaggtacttcccggagcgagcggggaacgcgacgtaccccagtgcgcctcggcacaccattgctccccgaaactggggtgtccaggcggaacagcagagcccaggtcccgcggcctatacggtgccctcgctcttgggtccgcgcgtcatcggcaaagtctccgccccaacttgctccatctacggccgcagagcggctggcagtttcttcgaggacctcagcaagaccccgggcccctgcgcctatcaggtcgtgagtccaggggtctacaagtcccgggccccccagttcacgattctggcgcggacttcgctcccccaagacaacactcggaagccagggcccgcggcctacaacgtggatcagcaccggaagccccgcggctggagtttcgggatccggcactcggactacctggccccgctggtgaccgacgcggacaactgacccgccaggcgggagcggccccacacgtgtttgcttaaagtctgcgagtccgcatcgtgtccgcctctctctctctctctctgcgcgtcctggcgcaaggcctggggtggagccacggctggggccgtgtcccaactccgaacccagcggggcggggcccgagcgtcgggcgaggccgggaccccagcgctgcgccgcgtccgaacgtcgagaccccaccgagggcgggagggggactctcgggagccacagacgcccgagacccacgccgggcgggaccggccagggatcacccccgccgacggccccgggccccgacggcccggaagttccgcgtgtccgggggcaccgggggattggccggggcgcggcgtgcaaggcttcccgggggcggcgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccaggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggttagaaaccacctcctttccagacgggagcctataccgcacatgcagcaaccagtccatccacaggcagctcccaacctcaagcctggcccaaagcctccaagaccctaccaaggcttctccccaccctgctcccca

SEQ ID NO: 359930 - DNA, 263 bp, Homo sapiens
aaaagaagggaagtgtcagagatggctctgctagactcacgtatttttcagtagaatctgggtcaggatggtgcggtcagaagatgcttctggagctctgggacccacaagcctgcgtgtcccacagtggagtattaggacaacttgaaaacatagtcagcagttcatcctccaccacacccaatgtgttcaatagatattggttaaatgaataatagggccgggcatggtggctcacgcctgtaatcccagcactttgggag

SEQ ID NO: 359931 - DNA, 1162 bp, Homo sapiens
actcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaataca

SEQ ID NO: 359932 - DNA, 1145 bp, Homo sapiens
actcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaataca

SEQ ID NO: 359933 - DNA, 1185 bp, Homo sapiens
actcagacaccgtgtcctcttgcctgggagaggggaagcagatctgaggacatctctgtgccaggccagaaaccgcccacctgcaggtgaggcccggacccctgcccagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaataca

SEQ ID NO: 359934 - DNA, 1233 bp, Homo sapiens
actcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacatgtcaaaaaaataatttctaactttttgtataattttttgggggggcctgaatcccaaattccttttgggg

SEQ ID NO: 359935 - DNA, 951 bp, Homo sapiens
actcagacaccgtgtcctcttgcctgggagaggggaagcagatctgaggacatctctgtgccaggccagaaaccgcccacctgcaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaataca

SEQ ID NO: 359936 - DNA, 735 bp, Homo sapiens
actcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgttggatgcagtcgcggcgttggatgcagtcagcggcgttggatgcagtcatctgaggcgtatgcatgccagggtgag

SEQ ID NO: 359937 - DNA, 1334 bp, Homo sapiens
actcagacaccgtgtcctcttgcctgggagaggggaagcagatctgaggacatctctgtgccaggccagaaaccgcccacctgcaggtgaggcccggacccctgcccaggtatgggcagatggccgtttcctccaccttccgccaccttcctgaaatgtggtgccaggggcagcttggtgtgtgaggggaaggagggttcccactcctgctgggccccggggcctgggctgaagaaaaggccccaccatccatccatgttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagacccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaataca

SEQ ID NO: 359938 - DNA, 1040 bp, Homo sapiens
  misc_feature (935)..(935): n is a, c, g, or t
actcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacggactgccggggcccaagggggagccaggaatcccagccattcccgggatccgaggacccaaagggcagaagggagaacccggcttacccggccatcctgggaaaaatggccccatggaccccctgggatgccaggggtgcccggccccatgggcatncctggagagccaggtgaggagggcagatacaagcagaaattccagtcagtgttcacggtcactcggcagacccaccagcccctgcacccaacagcctgatcagaa

SEQ ID NO: 359939 - DNA, 534 bp, Homo sapiens
  misc_feature (24)..(24): n is a, c, g, or t
aagatttccctcacccaagagggnaaaaaaaactttcttcttctaccacccccctcacttgctctgactgtcactcctttttttcttccagaatgtgtactttatattacatatgtacagtatcagtagggaaaatgtaaaaagatgttgttttcttttgtcatttaattaggccatctgtcctgttttaaagaaatagttaataattcaacactttatataacaaatattaactaatacccatatttataaaacatttttcagatttaaaagattgttaatacttataaacttagtgttattcttagaaaaccccatcaaatttaaatgtgatttacacagtgactaggaacatttgtatttattgtttcttctctgcacttttcatcatctgataaatacaagagctcaagtaactgtcttttcttcaagatggcttctatacttgaaatcagttaatacaatagtttttccagttctttttttatagagagtcaaagagaaataaaccaaattatattcaaaagttggaaa

SEQ ID NO: 359940 - DNA, 574 bp, Homo sapiens
agttcgacggagactctcttatttcttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacaggtgagtactaagtctacttggcaaacagttgaaaatttttttttttttttgctcatacatgaattctttctgtactagctatagaaaacatttatatatttcaccctatttctggttccttccttcccttaaggaaagttctgtagccgggtgcggtggctcaca

SEQ ID NO: 359941 - DNA, 348 bp, Homo sapiens
tgcagggtcagaggggagattgtttcattgcttttggtgttttccctaagcaagtcaactctaatgagagttgtcatttttcttattcctattgagtctatgaaatatgttaagtcaatctgtattatacatgattgaaaaacaatttccatattctatgtaaataaaattttataatggttttttattacaaaaatatctttatatccattttgctattttatgtagatactacatcctttgaagacataagtccacaaggtgttagtgatgattctagtacgggatcaagagttcatggtaagataatgaaccttatttagagagtacacattaaatacagaatgg

SEQ ID NO: 359942 - DNA, 10957 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaaaaactggtta

SEQ ID NO: 359943 - DNA, 7331 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaatcagaagactgaaggagttgaaagaccagtagacgctcctctactctttgagacatcactggcctataataaatgggttaatttatgt

SEQ ID NO: 359944 - DNA, 7514 bp, Homo sapiens
tttttttttaattttctattttctctttctagctctgaattttcttgttctaaggcctcaattttttcacaagtaatttttaaattagttatttttttctgtaataattcattttctttttcaagatgatgcaattcattttcaagttcttcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataata

SEQ ID NO: 359945 - DNA, 8099 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaaaaactggtta

SEQ ID NO: 359946 - DNA, 5777 bp, Homo sapiens
gagaatggggcagtaagaagaggataatttcatttgcctctttaacaaaaatgcttttataagacccatttatggcatgaatatttgtggtcataaattatctttaaaaataattttctgacctccaataatgaactacattactttgtacttggatagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataata

SEQ ID NO: 359947 - DNA, 6213 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagcagggctctgagagtctgagtggaagtccacaggcaacttgaggcctagacttggaactgttacaccatcacttccacctctttctcttggccaaaagcattccaaattcaagaagaaggaaaatagattccacttctttacgggaaaagtgagaagtcacattgcaagagggcataggtacagggaagaaaataaatgcattcagttttttaatgaatctaccacatatgttatgtttcaatttaacaacatacagataaataaaaccaacgtagtatgatattcacagttacagatc

SEQ ID NO: 359948 - DNA, 4689 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaatt

SEQ ID NO: 359949 - DNA, 3202 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattgtaagttgctgatttttgaggttcattgaatttatatggtcccaaaggtgacctaaacaatatttttaagcttatggaaatattgctagcttgtgtcagtgttttcacaagtaaatgagaaaaataaggaggttggcataaggttttcctattgttaaatcttaacagtttaaaggatgccttttattctggatttatggcctttctagcattctagtatgtatttttttaaataaaataatgtcctcatttggca

SEQ ID NO: 359950 - DNA, 757 bp, Homo sapiens
caaaaattatctctgattgtctgtcattctcattcttatagaaatacctggtgcatgctgttcttatagtggctgctctgtattttgtgtctctcttatctttaagcttttcttatattttctttcttctttctaccttccaactaaatacagagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatga

SEQ ID NO: 359951 - DNA, 10619 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcaccatgaatgacctggtgcagtccatggtcctagcaggacagtggacaggtagtactgagaatttggaggttcctgatgatatttcaacgggtaaaaggagaaaagaattgggagctatggccttctctactacagccatcaacttttcaactgtcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataata

SEQ ID NO: 359952 - DNA, 10903 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaaaaactggtta

SEQ ID NO: 359953 - DNA, 10848 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaaaaactggtta

SEQ ID NO: 359954 - DNA, 9327 bp, Homo sapiens
  misc_feature (9170)..(9170): n is a, c, g, or t
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaataccacatcaactgngagaaacatgtatttacagggcatttaaaaacctttaaaaaaaaaaaaaaatcctggggggggggccgggaccccaattccccttttagggggcggtttacaatacatgggcccggttttaaacaccggggtttggggaaaacccctggggtccccc

SEQ ID NO: 359955 - DNA, 8913 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctagtgagtaccatttacaccagtggtcctctcatatacttgacatcccaacacatactataggttcttgtgcccaaaatgatttagctatagacatgcctgagcctctatatgcccaggctagaaactcaagaacaggaaggtcacattttctaaaccaaacttttgccactattaggatgcctagtgatgcattcggaatgttggcaaaagatagcataggaccatttactgtggcccattcatctcagccattcttatccctgaatacagaattagttagtaacataagtgggttacctcctaggccagtcatcagaataactgaccaggcttctgcctctttggataaacctgcacagaaagaaaatgaacagttttctgatcatcagaaccctagtaacagtaacctacagttttctataaatagcaacaatcttgtcacttctgcatgcctctatcctgatgacacagaagctgcattgttggtttctgaggataatcaaactgtttggtatgaatatggttgtatatgatcaaaactgcacaatataatatattgatgttatttgatatacactgcttctctaatatgatttgaaaagttgctgttaacaaaatatcatttggctaggtttttattttttatttaaaattgttgcacagtgttcagctgtacatgatggcatgtatattaatgtgaatgtgtaaccacaccaaaacctgcatgaaatattaattactttgtccattttctgcatgcctttaaaaaccttaaccatacatgctcctccttcacattttttgttgcctgataagattgttactttgatatccagaagcatgttaaaacagttgcatgctctcttaccaagaagacatttccaagtcatatttgctttgttgcttctggaaaaaaatgttcatttcctccctcccttcctcctcttcccacccctcacttgctctgactgtcactcctttttttcttccagaatgtgtactttatattacatatgtacagtatcagtagggaaaatgtaaaaagatgttgttttcttttgtcatttaattaggccatctgtcctgttttaaagaaatagttaataattcaacactttatataacaaatattaactaatacccatatttataaaacatttttcagatttaaaagattgttaatacttataaacttagtgttattcttagaaaaccccatcaaatttaaatgtgatttacacagtgactaggaacatttgtatttattgtttcttctctgcacttttcatcatctgataaatacaagagctcaagtaactgtcttttcttcaagatggcttctatacttgaaatcagttaatacaatagtttttccagttctttttttatagagagtcaaagagaaataaaccaaattatattcaaaagttggaaa

SEQ ID NO: 359956 - DNA, 7845 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattataaagaaaaaggagaacgagctgaagaacttgaaaatgaattgcatcatcttgaaaaagaaaatgaattattacagaaaaaaataactaatttaaaaattacttgtgaaaaaattgaggccttagaacaagaaaattcagagctagaaagagaaaatagaaaattaaaaaaaacattggatagctttaaaaatctgacctttcagttagaatccctagaaaaagagaattcccaacttgatgaggaaaacttagaactgcgaaggaatgtagaatctttgaagtgtgcaagcatgaaaatggctcagctacagctagaaaacaaagaactggaaagtgaaaaagagcaacttaagaagggtttggagctcctgaaagcatctttcaagaaaacagaacgcttagaagttagctaccagggtttagatatagaaaatcaaagactgcaaaaaactttagagaacagcaataaaaaaatccagcaattagagagtgaactacaagacttagagatggaaaatcaaacattgcagaaaaacctagaagaactaaaaatatctagcaaaagactagaacagctggaaaaagaaaataaatcattagagcaagagacttctcaactggaaaaggataagaaacaattggagaaggaaaataagagactccgacaacaagcagaaattaaagataccacattagaagaaaataatgtgaagattggaaatttggaaaaagaaaacaaaaccctatccaaagaaattggtatatataaagaatcttgtgtccgtctgaaagaactagaaaaagaaaataaggagcttgtgaaaagagcaactattgatataaaaacgttggttacactacgtgaggatttggtgagtgaaaagttgaagacccaacagatgaacaatgatctcgaaaaattaactcatgagcttgagaagatagggttaaataaggagcgactcttacatgatgaacaaagtactgatgacagtaggtataaacttttggaatcaaaattagaatccactcttaagaagtctcttgaaataaaagaagaaaaaattgctgctttagaagctcgattagaagaatccacgaattataaccagcaattgcgccaagaacttaaaacaaatgctacactgcaagcagagaagcaagcgttgaaaactcaactgaagcaacttgagacacagaacaataatttgcaggctcagattcttgcacttcagaggcagacagtgtcattacaagaacagaataccactcttcaaacacagaatgccaagcttcaggttgaaaattccacccttaattcccaaagtacctcactcatgaaccagaatgcccaactcctaatccagcagtcttccttagaaaatgaaaatgaatctgtaatcaaagagcgagaagacctaaaatctctctatgattctctgatcaaagatcatgaaaagctggaacttcttcatgaacgtcaggcttcagagtatgaatctcttatctctaaacatggaactctgaagtctgcccacaaaaatcttgaggtggaacatagagaccttgaagaccgttacaatcagttattaaaacagaaaggacagttggaagatttggaaaaaatgctcaaagtagaacaggaaaaaatgctgcttgaaaataaaaatcatgaaacagtagctgcagaatacaagaaactttgtggtgaaaatgataggctgaatcatacctatagtcaacttttaaaagagactgaagttttacaaactgaccataaaaatttgaaaagtcttctgaataattccaaactggaacaaacaagattagaagctgaattttcaaaactaaaggaacaataccaacaattggatattacatcaaccaagctgaataaccagtgtgagttgctaagccaacttaaaggaaatttagaagaagaaaatcggcatctactagatcaaattcagacattaatgctacagaacagaacacttttggagcagaatatggaaagcaaggatctttttcatgttgaacaaagacagtacattgataagttaaatgaattaagacgtcagaaggagaaactagaagagaaaattatggatcaatacaaattttatgacccatctcctcctagaaggagaggcaactggattactctaaaaatgagaaaattgataaagtctaagaaagatattaatcgggaacgccagaaatctctaacattaacacccacccgctcagactccagtgaaggatttcttcagctccctcatcaagacagtcaagatagttcttcagtaggttcaaactctttagaagatggccagaccttggggaccaagaaaagcagcatggttgcactgaaaagactgccctttttgaggaacagaccgaaggataaagacaaaatgaaggcctgctaccgtcgttccatgtccatgaatgacctggtgcagtccatggtcctagcaggacagtggacaggtagtactgagaatttggaggttcctgatgatatttcaacgggtaaaaggagcaactcttctgcaggcttcagatccaagcagttggttaataataaagatactacatcctttgaagacataagtccacaaggtgttagtgatgattctagtacgggatcaagagttcatgcttcaagaccagccagccttgatagtggcagaacatccactagcaatagcaataataatgcttcactacatgaagtcaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataata

SEQ ID NO: 359957 - DNA, 4442 bp, Homo sapiens
gaatgctttgtatgaggctctgtttaggctctgagtatgatagtaaaagcaagtctttgcccttatggagcttacaatagttgtcagtttgacaaaataaggaagcaggctatggcagacaattgttagactgataaaagattgacatggtttactaagcatttctaaataaagcttgaaagtaaatttggctgttcatataattagcacacagtcaacaaatgttattactcatgaagtattaatctcaattctattattgaaatctcaacaccccatttactccaaaagcaggtgcagttaataaccaaagcaggccacaaagccacagcagtggagaatttagcctgcttcatgaccatgaggcttggtccagcagtggtagcagtccaatccagtacttgaaaagacagaccagatcaagcccagtgctccagcacaaaatatctgaaacactggagagtcgacatcacaagatcaaaactggttcccctggaagtgaagttgttactctacaacagtttttggaagaaagcaataagcttacctcagtacagataaagtcctcaagtcaagagaatcttttagatgaagtaatgaaaagtttgtctgtctcttctgactttttgggaaaagacaaaccagttagctgtggtctggccaggtcagtaagtggaaaaaccccaggggacttctatgatagacggacaactaagcctgagtttttgagacctggtcctcgaaaaactgaagatacctacttcattagttctgcgggaaaacctacaccaggcactcaaggaaaaataaaattagtaaaagaatcttctctgtcacgacaatcaaaagatagtaacccttatgcaactttacctcgtgcaagcagcgtgatctcaactgccgaaggaactacacgaaggacaagcatccatgattttttgaccaaggacagtagactgcctatatcagttgattcaccaccagctgctgctgacagcaacaccactgcagcatctaatgtggacaaagtacaagaaagcagaaattcaaaaagcaggtctagggagcaacaaagctcctaattctattacccactacatgacatgtgggccaagtgagagaaaagtgtccttcagtttctcagtatgaagcctttatttctgaagtaacaagacacctagcaactataggaatcatttttaaaaatctttaaggagacttttaacagtccttcgtgaatagagcaggcaagaaatacaaaccttcattccttgaatcaaggagcactactggattcaactgccaaaattttttaaaggttttaggacttactataccttgtactgttaagatctactgaataaaggacgttctctcactaaggaccaggtgttttaaggttaagtgtttaaagaagtactccaagaacaatctgcttttttcatcatttgttttatgaatttatccatgtttgcttaatgcttctgctaagtgttagccaaaatctagccatttatatttagttgtgtaaacctaaattaaatgctgtagtattttgtggaatgtactatatagcaagatacagagaaaattgttttggcatgtcagagccttatttggttagcagactgcatgtgttgatactttttttttcttaaagccaattattttgatgcaaaagaaattcagtttataagataaatctgaaaaatccataatgaaataggagttataaaaaatttatagtgatattaatctttccatatttcccattaagcaacactaagcattcataagttaacccatggtaaagagtgtttttctgaaacttttttttagtaagatggtttttcagcaaatggcattcccaagataaagctgttgtgctttaactcatttcttttctttggtattgggttatgtatgcgtgtgcatttttttaacttgagagctgactgttgcttaagaagttttcttatggcaaaaataatgtaaataagttactatgatctgcattttgccagaaactcatttataattaaggctatcatttattaatgatttttttctcctttatgatattacattaaagttgataactgttattggtacttttgaaatatttgtatgcatttgttacctttaaacatttggaagaagcacaaaaaaatagatttagttaacccagggaaacatcaatttttttagtagttccaattttatatcacagttttattttcttatgaaatcaaaaaatgcattgatactcattaatgcaaattcattatttaacatcaatatcagagtaatcttcaaggtctgaaatgagaaacatactgactttttaaaattttaacagtgtacttcttaggctttcattaccagctctgaagaactttttggaataattccatattccatagtgtgtggtttatgagttgtgggtttcatcactaacccagtaaccataagaaaagtctctctctctctctctctctctttctctctccctctttctctctctctttcgtaggccagtagcaatgttgtgttcacagtctaatttccaaaagaccatcaataaaaaagagagcatgtttaaattgaaatggaacttagagaacttgagcttacttacgtacttcaatgccaccggtaacttaggttttaccaccaaatgctgttaacattaaatcattttgaaaatcttggatgaaaggtgctatgtaaatggaaatacaaaggattcttactaacatacaaaaataatgcacaacagaaatatctaaaaccttttccgtagactttgaaacatctctctctgtcataactccctggattcaagtagcacattggtaataggtatcagagcagtctagagacaattgcatgtcaaaaaatgtacattcatttttaggtgggataaaagtaaacatagaaattatgttatggctaaatacagttagtgggtaacttagatttatattagctagcatctaatttgcacaactagaacacatcccagaacaattactgaaaagctgaaatttaatgggtggtgatgtagcccaatgagggcgaatgacattccagcttgacctctccagaacactaatatcctaaaatacagaacatgctgggttaagtgcattagtgcttcaagcagaaaatgctgaaaacaacgtgtaaagtactgaatctgagtaggctgaccctgagaagggacaattaaagagacaaccaagggaacacattgagactacaaaaatatgaataatctcaattatattcatcacacttttttcataccatttcaagaaacgactagacagtagtaaccacatgaatattttactttctccagtataccttgagaagcaaactttgtaggaagccactcttctcccctaaacaacttctgccaaacaataataaagccaactggaaacgaatcggagccattttcattttcctaaccggggcctgacatgctttaaattatctggctgtattctaaatcaacacctaacccctcaaggaaactgaagaatcaatatacagggtaatagctttggctcagagctccaataatgtgcttcagatctgtccatgtggaaatgctttcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttaagtcttgaatgaatacaaaaggagcccattttataatataaaccttgatgtacatgttgagatatttggacaatgaaaatgccttaaaaggaatgcatatggataaagttgcacttataacacccttcaacaaaatctaattttaaattgtctttttcttttctattaagggttttctttttcagtgtctaccattgtacttataactgttattaaataccaaatcaaataatataaaagctgtaacatttcctttaaaactaatgctaataagggatttagagttgaatggcaaaatgtttattacttggcaatacctgatgtcagtcacaggcatccaactcatgacaagagataccactgtttgttttttaaaaaacatttttcattttgtttctccttcaaaaattaagttggactaacattcacgtatcaaactaatataaaaagaaataaaaccaagaggtgatttttgtaaaaactggtta

SEQ ID NO: 359958 - DNA, 4006 bp, Homo sapiens
aaggaataatgttaaagacaacattaatgacatttatagaacacttaactataagctgccatttcatttaaccctattattagccctgctttacacgtgacggaatcgaagcacaaagagactcaataacgtgcgtaggctcacacagctggtgcatattggaaccaggcaggaagacttcagagtccaggttctcaactacccaattaagaaattctgctctttcttaactgtgttatgacaaaaacatttttactgctaatttaaaatatatactccgtgtaaatatttatgtaatgtaaacatagcacacattataaaactataatattatcttttatcaaaaaaagattgcgttctatatgcccattttaccccgggaaaaaggtctttattttcctttgaaatgaggagtagcatttgattttgccagggaacttaaaattatttcaaggtcccagtcgtacgtggcatggagatttatgacaaatatgtaatctgtttatttgtcacccaacttggatgacttctaaatgtttcttctttgtagctcttgattttgcttgggtttcccccgacccatgcccaaatagtaaaaaacaaaacaaaaccaaaaaacaatgtctgagtcatgtttgctccagtcagggaataccaacgtgctgacagacagctctggtttttaaaaaatcttactgtatgtcacttgcaactttgaagaacattcatgcgttagtggactgcatttggaagaaaacaaaaaggagaaaaaaacccccaccaagttgtggctcaagtccctctgccatttgctgcagtgagttttcctattccattttgctggggagaaggcatgctttacagaacacatcaaactgtccgaaaaaggctgtctgcatccctcatgtttataagagaaggatttctttccccttccttcacgtatcaaagaagtcactcggggaggaaataaaccataattaggcatgagcgagcgagcagacagaccccttgctctgccttccctgtccccgcccaccaggcaaccgtcctgggcgcaaccgaggagcgggttgtctccgcagcagctgcagcgagcgcgcgcccacgcccgagcccgcgcccgccgccaggatctgggcggcggcgaggctagcccgggggcgcgctcgctcgggagcgcgctcatgcagcggttttcttctcccacaatccagaggcagctgcacgggaggggcggggagtcggcggaaggatatcggcgcggagggagcagcgcgctccctttgacggcggcccccggcattggcgggcggcgctggcgggcggcgaggggtggggtgtgatgcggcactgcggttctgaggccgttactccggcttctccatagagggcggagaaggctggagcgcggcggtgattttgtgccagggattcccagagacgcgctgaaaggctggcagggcttaggaagctggggggttagggacacacattcaagcccccacccccgggaggggaagggggctggaggcgaggcttgagggcggcggaggaatggtgtctgctcggggggaaggggcgagccctgcctgttggtactgaggggctgcgggcagtggaggctccgcgggtcgaaagcggctccatgcccatcggtgggtggaacgtgtagaggtcggaacgccgaggtcgagtctggtggcgcctcggtatccttaacgtggtctctgtttaacgtatttcatttagcccccgttgggattgattcattgggagcagtttcgctggtctggatcctccaggagctggacaaccttgacgggctttttgtcttgggttccagccccctttcccttcctcctcctccagatgccttttctctgcccctcctcgcccggtacagacatttccagcgcaggctgctgctcgtggtgtccgtcgtcgaagccacttcttgggatttcggctcgtttcactctggggtgttttttgaggagggagagtgcccccctcctccacgatgggatttttctcccttgccgaaatggactttcattgatttctacttacttccacgtttagtgaccaattccctaggcgtatttttgtggtagttccttttttcaaatacatactctgtaaaatggagaacgaaatttttactccccttctggagcagttcatgaccagccctttggtcacttgggttaaaacgtttggacctctggccgcaggaaatgggaccaaccttgatgaatatgtggctttggtggatggggtattcttgaaccaggtcatgctccaaattaatcctaaattggagagtcagagagtaaataaaaaagtcaataatgatgcctcacttagaatgcacaatctatccattttggtgagacagataaaattttattaccaggagactttgcagcaattgatcatgatgtcgttgccaaatgtcttaatcattggcaaaaatcccttttctgaacaaggcacagaagaagttaaaaaactgcttttacttttattgggttgtgcagttcagtgtcagaaaaaagaggaatttattgaaagaattcaaggtttagattttgatacaaaagcagcggttgccgcacatattcaagaggtaactcataatcaggaaaatgtgtttgacctgcaatggatggaagtgactgatatgtcgcaggaggacatagaaccactcttgaaaaatatggcattgcatctaaaaagacttatagatgagagagatgaacattcagagactatcatagaactctctgaagagcgggatggtctccattttctaccccatgcctcttcatctgcacagtcaccctgtggttctccaggcatgaagcgaacagaaagtcgacaacatctgtcggtggaactggcagatgctaaagccaagataagaaggcttaggcaggaattggaggaaaagactgagcagttgttggattgtaaacaagaacttgagcaaatggaaatagaactcaaaaggctgcaacaagagaacatgaatttgctttcggatgctcgctctgccagaatgtaccgagatgaattagatgcacttcgagagaaagcagtcagagtcgataagcttgaaagtgaagtcagcagatataaagagagactacatgatattgaattttataaggcaagagttgaggaattaaaagaagacaatcaagttttattagaaacaaaaaccatgttggaagaccaactagagggaactcgtgctcgttctgataaattacatgaattagaaaaagagaacttacaactgaaagctaaacttcatgatatggaaatggaacgagatatggatagaaaaaagattgaagaattaatggaagaaaatatgactttggaaatggcacagaaacaaagtatggatgaatcattacatcttggctgggaactggaacagatatccagaactagtgaactttccgaagcaccccagaaatccctgggccatgaggtgaatgagttgacatcaagtagattattgaagctagagatggaaaatcaaagtttgacaaaaaccgtagaagagcttcggactactgtggattctgtagaaggcaatgcttccaaaatcctgaaaatggaaaaagaaaatcaaaggctcagtaaaaaggttgagattcttgaaaatgagattgttcaagaaaagcaaagtcttcagaattgtcagaatttaagcaaggatctaatgaaggagaaagctcagcttgaaaaaacaatagaaacactgagagaaaattcagagagacagattaagatactggaacaggaaaatgaacatctgaatcaaacagtgtcttccttaaggcagcggtcccagataagtgcagaagcaagagtgaaagacattgaaaaagaaaacaaaattcttcatgaatctatcaaagaaacaagtagcaagctaagcaagattgaatttgaaaaaagacaaattaaaaaagaattggaacattat

SEQ ID NO: 359959 - DNA, 349 bp, Homo sapiens
taattagccaggtatggtggcaatcgcctatagtcccagctacttaggaggctgaagagggaggattgatagaggctaggaagtcgaggctgcagtgagccgtgatcatgccactgcactccagcctggacaacagagcaaggccttgtctcaaaagaagaaaagaaaagaaaatgtgaaccacagattaggagaaactatctgcaatgcatgtatttgtcaaaggacttgtattcagtataaataactcctacagtaataagaaaataaaaacccaaataagacactgagaaaaagatttgaacagacatttcataaaagatgtatgaatgaccagtaagcatacaaa

SEQ ID NO: 359960 - DNA, 814 bp, Homo sapiens
cccccactctaggcggcgacctcagcgcctccgccccggggcccccgctcacccaggtatcgactccgcagccgggacgggtcctccagcccgagggaccttttcctcacgtcccacaacagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359961 - DNA, 880 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359962 - DNA, 324 bp, Homo sapiens
tattgatgattatttttctttctgttttctttatagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359963 - DNA, 2386 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttatgctgttgtacttttttttttttttttttttgagacagggtctcgctctgtggcccaggctggagtgcagtggcacaatctcggctcactgcaaaccctacctcctgggctcaagtgatcctcctgcctcagcctcccgagcagctgggactacaggcacacaccaccacacccagctaatttttgtatttttttagaggtaggttttgtcatgttgcccaggctggtctcgaactcctgggctcaggtgatctgcccgcctcgtcctgtcaaagtgctggaatacaggcatgagccaccatacccagcctatgctgtgactttagacaagttaggaaagtacctagcagagtacctgggacataagtaggttttctgtaaatgtttgtgacctttggctccgttgtgaggagagactgagcatacattactccacgctacaaataattaactatctatttgatttgactttcagtgtggagtgcagagctttttttctaaaagtgctaataaagccagtcctcattaaaaatatagtcagatgagtcagcaaagcaagttatttcaaaatttgaagaaatgagacaaaacaactttttgagtaatactataacctatgaaaatttggcagttagcaattgaaaaccttgtactttatcatctgtcccttaaccatggcctaccattgaggagaaaagattagagagcttgacataggccacaatgaagaggttctgaagagtcaaactattattgctttcatttcataaaccacactgttaaattcatttgtgtgtttggcatgggtgtgcacacatgtgtttcctaggttaagcatttaggaaaaacattatgaaatatgacatagacacaaaaaagtttattaaaaatttatgtgagcttggtgtttcacttccttttcattaaaacctcttctgtgcggggtctccta

SEQ ID NO: 359964 - DNA, 2342 bp, Homo sapiens
  misc_feature (2339)..(2342): n is a, c, g, or t
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttatgctgttgtacttttttttttttttttttttgagacagggtctcgctctgtggcccaggctggagtgcagtggcacaatctcggctcactgcaaaccctacctcctgggctcaagtgatcctcctgcctcagcctcccgagcagctgggactacaggcacacaccaccacacccagctaatttttgtatttttttagaggtaggttttgtcatgttgcccaggctggtctcgaactcctgggctcaggtgatctgcccgcctcgtcctgtcaaagtgctggaatacaggcatgagccaccatacccagcctatgctgtgactttagacaagttaggaaagtacctagcagagtacctgggacataagtaggttttctgtaaatgtttgtgacctttggctccgttgtgaggagagactgagcatacattactccacgctacaaataattaactatctatttgatttgactttcagtgtggagtgcagagctttttttctaaaagtgctaataaagccagtcctcattaaaaatatagtcagatgagtcagcaaagcaagttatttcaaaatttgaagaaatgagacaaaacaactttttgagtaatactataacctatgaaaatttggcagttagcaattgaaaaccttgtactttatcatctgtcccttaaccatggcctaccattgaggagaaaagattagagagcttgacataggccacaatgaagaggttctgaagagtcaaactattattgctttcatttcataaaccacactgttaaattcatttgtgtgtttggcatgggtgtgcacacatgtgtttcctaggttaagcatttaggaaaaaccccatccttcaactctggaggttccacaaggctataaaggtgagatgttactgcannnn

SEQ ID NO: 359965 - DNA, 878 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359966 - DNA, 643 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacaggttatttgtcaagatactcacttgtatattccgggatcctctaggcacctc

SEQ ID NO: 359967 - DNA, 992 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359968 - DNA, 748 bp, Homo sapiens
cccccactctaggcggcgacctcagcgcctccgccccggggcccccgctcacccagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359969 - DNA, 2334 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgtatataccccctgcctccttctgttccagtcagccaacatatgtacataaaagaacacacaaattcaagaagttggaagattaaattatctgcttatttagtgtaggatggtcaggtagctagctataagtgaaaggaaattttgctgaagagactgagaaatgggtagtggaatgactatcaagatgacctcaaactatttaaaaacattttaacttgccatgaagaatcttgatgatttttgtataaatgttgtataaaattcttttacagctacagatttttaaataggatcattgtaaagattaatgagataatgttttaacatagtgcctggtccatgataagtgttaaatttttcaattaccctcagtaactgataatgtagcagaaaatactctatattcagacagacctgaatttgaatcccagctctatgacttatgctgttgtacttttttttttttttttttttgagacagggtctcgctctgtggcccaggctggagtgcagtggcacaatctcggctcactgcaaaccctacctcctgggctcaagtgatcctcctgcctcagcctcccgagcagctgggactacaggcacacaccaccacacccagctaatttttgtatttttttagaggtaggttttgtcatgttgcccaggctggtctcgaactcctgggctcaggtgatctgcccgcctcgtcctgtcaaagtgctggaatacaggcatgagccaccatacccagcctatgctgtgactttagacaagttaggaaagtacctagcagagtacctgggacataagtaggttttctgtaaatgtttgtgacctttggctccgttgtgaggagagactgagcatacattactccacgctacaaataattaactatctatttgatttgactttcagtgtggagtgcagagctttttttctaaaagtgctaataaagccagtcctcattaaaaatatagtcagatgagtcagcaaagcaagttatttcaaaatttgaagaaatgagacaaaacaactttttgagtaatactataacctatgaaaatttggcagttagcaattgaaaaccttgtactttatcatctgtcccttaaccatggcctaccattgaggagaaaagattagagagcttgacataggccacaatgaagaggttctgaagagtcaaactattattgctttcatttcataaaccacactgttaaattcatttgtgtgtttggcatgggtgtgcacacatgtgtttcctaggttaagcatttaggaaaaacattatgaaatatgacatagacacaaaaaagtttattaaaaatttatgtgag

SEQ ID NO: 359970 - DNA, 859 bp, Homo sapiens
gactaaccagaacatccaaagatcagcaacagtctcctccctcagcccccctccaacaggaggaggcggaggcggaggcgatggcgactcctccctctcctcgtcctggataccctccccgccaaccctttctcgcgagatgacgaccaccctggggactgaggctgccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatgcagcaaacttttaataacagtctctctacatgacttaaggaacttatctatggatattagtaacatttttctaccatttgtccgtaataaaccatacttgctcgta

SEQ ID NO: 359971 - DNA, 1003 bp, Homo sapiens
ggccaatcatggcgggcagctcggcctgcgcaagcgcgctgccagcagggcgcagcgcagacttggtgaggtgattattttggcacctgttgccatggctcctccctctctcctgccgggggccggaggcggaccgggggctggcagtcggcagcctccgccccctcaaccttcgcggggcgcgggccgcagcttttcggttcacagcgggcagggaaagccgcgggaagggtactccaggcgagaggcggacgcgagtcgtcgtggcaggaaaagtgactagctccccttcgttgtcagccagggacgagaacacagccacgctcccacccggctgccaacgatccctcggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgctgttttgatggctacagggtttatttggtcaagatactcacttgtaattattccaaaaaattggagtctgtttgctgttaatttctttgtgggggcagcaggagcctctcagctttttcgtatttggagatataaccaagaactaaaagctaaagcacacaaataaaagagttcctgatcacctgaacaatctagatgtggacaaaaccattgggacctagtttattatttggttattgataaagcaaagctaactgtgtgtttagaaggcactgtaactggtagctagttcttgattcaatagaaaaatggtgctcagtaagaacgagttccccgaggtgtacgtgaccaccgttttcgagaaatatgaggaacacttttccgccgtgtgtccgtaatgaacctggctaaatagtatatgaaaaaaa

SEQ ID NO: 359972 - DNA, 336 bp, Homo sapiens
caggcctacgggtggggcgagctccttgcccaaggcagagggtagctggcccgtgagcccaagtcccttgacgctttgtaatcacggacctccacagtgcaggaccccagcacgagatagcgtttcacctcctccaaacgtctctctccaaggagagtcgggaggaaaataccccaaatgcttaccggggctttgctttctcttttttcccccctacatccctgtattctccgaattatttggacactggtcatatattaggttaacttcatttttctaaataaaaaggcttatttcctgaatagaaaagaaacacgtgcttactgcaaacaagca

SEQ ID NO: 359973 - DNA, 682 bp, Homo sapiens
aaaactgttaaggagtcaataacgaaacattcaaagaaacccagccagttacaggacaggctattttgtacgtctttaaaaatacgctactgcattgttatcaatttctaaattcccagtctgaagcaatgtaaaatttacgtagttgtttatcattttaaatgtttacatgatagaaatatttttaaagttcaattctctctcatgttcaaagataatggaacctttccctcaactttgctcgggaatcttcactaattaaaatttatatttctggttcattattgttatttaaatttaaaggaaagagttgataaattggtacatatttataatataatttattcattaatcattggagaggtattgtgctaagagtgaaagagtacaaaattttgagccatgggcaatgacttaaatcctgtttcttttgcttaattagctctttggccttagaaatttatttaacctcctgattttcagtttcttcattaaatacttgatgagtatttgaattaaagtaacaatacttactttatagggttgctgttataattaaataaaacattgcaaggcatgcagcagacactgtatttgacatttatgtggcttttaaaaaaatgtcattaatcctttattaagggccacctcaacacacttgtgatttattttgttcatgggt

SEQ ID NO: 359974 - DNA, 404 bp, Homo sapiens
gcacattctttagcacctactatttgtatcagtcatttgacatttacagtatttaggaagcctgatggccattttttgttttattggatcaaattcttttactatcttttttttttttttaactgagacatcttgcagggcacagagttctctgcaaagatattgttggttctcctggtagaggtgatgaggagggggtcatactgaagtacatctcattcttgcccacctcatgaccatatttccctttaagaattcaaatgatgcatcctccatgatcgatccttaagcacctttgatgtcttgctctcccttgctgaaatggctcacataatgggagctttaactgaaggagagatggagctaggaatataaagatcatttttgcctgggtgtagtggctc

SEQ ID NO: 359975 - DNA, 3697 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcttacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359976 - DNA, 3491 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcttacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttggaaagggggttcccccatgtgttgtggccaggatgtggttcttcaattctctccgtgaccttatatgtgatctccgcccactcttgcggcctctcccaaagggtgcgtgggatttccggggcgttgacccactgcgaccctgtggcccgtggtgataggtgatatatcttataatctccatatctccacacacaacctttattgggcgccggggttatcacatataacagggggtctcatatatattggcgtccatatattttctcccacaagtgtggagaatttacagtgttgttatgtctcacacgagaagaatttctccccataaacacatttttttctcctctatatatatttttaaagcagggggggagaatcctacagctgtctcttataaaaaagaaaaaagaccacaccagcttatatatctccagaaaacacgcgtggtgagaaatggtgactcctcctataatgattttttaggagacaaaacccaaactcctccttatacatcctgctggtgggggccccaaaaatattatttgttggggggcgttcgactctccagaagaagatatctcccctataatatattcgtcctttttaagacgactgtgcaaaacaacaaagaaatctcttctcttatcgagggatttataatattttccccagggtt

SEQ ID NO: 359977 - DNA, 1899 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctc

SEQ ID NO: 359978 - DNA, 2449 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgaaccaccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttcttatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagagaaaaacttg

SEQ ID NO: 359979 - DNA, 3434 bp, Homo sapiens
aagtaaaagaaaaacacaggaaaacttcaaatccatagcagtggggaaaggggaaatttgccatgttgagaatccatttgctcctttgtgagtgatcatttattttcttcttaaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtcttgaactcctcacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359980 - DNA, 2512 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaagttacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359981 - DNA, 4146 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtcttgaactcctcacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359982 - DNA, 2825 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagtgctgggattgcaggcgtgaaccaccgcacctggccctggtagtgatatttaatccaatccaacaactataggctgggttaaataaaaggtcattattgtctatattccaagtggaattaaatgtagtcacagagattcctaacattttccttatatttaagggaaatcacttctaaaaaaacacactaatcagaactgtgatgctctaattagaaacaactcatctggccaactatttgctgctcagagtttcttatttcttagatgaaaaaaactcatcagttatattcatgtgatcgcggctaaaaagtcagtattttctttttgttctaatgtggcttcatttgaaatttctcagattctacattgtactaattatgaataacaaattataaattaaaaactcttaaagagaaaaacttg

SEQ ID NO: 359983 - DNA, 2663 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359984 - DNA, 4096 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtcttgaactcctcacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359985 - DNA, 3059 bp, Homo sapiens
caatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgtgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttcctcaggactattaacccctgcaaagtttctatagggaactgcctagtgtaacaatgaaaccagatttctcacttgctcttcatacttctattttgaggtaactgttgtaactatgaaatgcttatctgaaagtagtgcttaaacctgatttctaaaaattatcccattttctgatgatttgaaggggagaaaagccagtgtatgtaaagaaaatgttccagccaggcgcggtggctcacgcctgtgattccatcattttgggaggccacagtgggcagattgcttgagcccaggagttgaagaacgtggcgaaaccccgtatctattatttaaaaaaattgaaaaagtaaaaaaagaaaagggaaaaaaaattttttaaagaagatgttccaataattgcaagaagaactcttagatggggaaacaggacagaaataactcaccgcttttggttgatcctcaaacatagcgctacctaaatgccactgggagagacctcctgcaaagttttctttagcccctcttttatcccacaatacacaagatataatccatttttatatatcccaaagttgtggcaacagcttctttcttttctgctcaatgccactttgtttcctagtaattcatgaccactattaattctatcattgtcactgctcctgcttaagatcacttctcaaggatacctcagtaagcaatggataaatcaactttttgttatatgtgccaagtactaagtttcagggttctcttcagcaatcattaattaatacttcagccattaattcagatgcaaataattttcttttttcttttttttgagatggagtttcactcttgttgcccaggctggagtgcaatggcgtgatctcagctcaccgcaacctccgcctcccaggttcaagcgattctcctgcctcagcccccctagtagctgggattacaggcatgcgccaccacacccagctaattttgtatttttagtagagacggggtttctccgtgttggtcaggctggtcttgaactcctcacctcaggtgatccgcctgcctcggcctcccaaagtgctgggattacaggcatgagccaccacacccagccagatgcaaataattttcttagaaaattatttcaaaagttattttaggcccagaaatcaaggattgttccaaccatgaaaatgggtaagacacctgccttaagcaaatctaacctgctattacttgccaaattttatatattcttttctcttgcctgtatttctaattagtgatttgtttaatgaagaactcttcatgtagagcaattaactgggcctaagaaatttcgaagctttccatgacataaagtggttaaaaaaaaatgctttgacagtcttcttctgccattagttcaactgcctttacgcttttttttttttttttttttttgagatggagtttcactcttgttgcccaggctagagtgcaatgggcgtgatctgggctcactgcaacctctgcctcccgggttcaagcaattctcctgcctcagcctcctgagtagctgggatttcaggcatacgccaccatgcctggctaatttggtatttttagtagagacagggtttctccatgttggtcaggctggtctcgaactcccgacctcaggtgatctgcctgccttggcctcccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttaaggtgactggaacttttgtaaaatacacttatgatcctacggggccttttttttttttttttctgctttcctaaatatgaggcaatagaaatttataatttgagactacagtaccccttgttttagctcttatcacagctggcaactggtagtgattttttttgttgttgttttgttttgttttgagatggagtctcgctctgttgcccagggtggagtgcagtggcacgatctcggctcactgcaacctccacctcctgggttcaagtaattctcctgcctcagtctcccgagtagctgggattac

SEQ ID NO: 359986 - DNA, 446 bp, Homo sapiens
gccgagcacagcttgaggttagaaggaaaacaaggtgcccagatatctccacacctccaagtgggtaagtgacaggaaccagccttccttctagagcggtttgtgaacccagatggatttcaaattgagtgcactcgaggtattgtgtaagagaggacagattttcggccgggcacggtggctcacgcctgtaatcccagcactttgggaggctgaggtgggtggatcacgaggtcaggagattgagaccatcctggctaacatggtgaaaccccgtctctactaaaaatacaaaaaattagccaggtgtggtggcaggtgcctgtagtcccagctactcgggaggctgaggcaggagaatggcatgaacctgggaggcagagcttgcagtgagccgagattgcactactgcactccagcctgggtgacacagcgagactccatct

SEQ ID NO: 359987 - DNA, 914 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgagcgtcagcggtgcccacttggctggccatgacagatgtcgcccgtgcctccaaggttccgcccatcggctctggctccagtcccgcccttcttgactcgcctctcgccct

SEQ ID NO: 359988 - DNA, 438 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggaggtaggagccctgtgggggtg

SEQ ID NO: 359989 - DNA, 1991 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtcaaaaaagaacaaagcacaaaaccacacacaaacaaacacaaccaaacccccccacacccaaaacacagaaacaaacacaaacacaaacagcacagaaggagcaaaaaagaggggggcgccgccccactaataaagaaacaccgagggagacgagcccaatcgcggagcgccacggttgtgcacacggacggccccaatgagagcggccgtcagaaacagaggcgggcaccgcgcggacacaacacacaggaggggagacaaccacgcagcgcggcgcgaacggggcaagaccacatcgcggcgag

SEQ ID NO: 359990 - DNA, 1742 bp, Homo sapiens
tttcagacgaccctgggttccagtgttggctgtcatttaatagcggggttactttgggcatgtcacttaacttacttgagcctcgtattccttcccttactcgcagtgtgggcagtacaatagcaacttcctggaagttgctgtaggaagaccaataatgtgtgtaaggtacttggtccttacatacattattaaatctgttggtttcttcctcccattcttccgttataatctaaatcccgatttctttttggttgtgaagccagttttcctgtccttctggtttgcctagctgttccttccctttgattctcattgcttcctcacttccacgctacaaatcttacatatgatttccttgcattttgcttccaactctgcctcttcctgagccctgagtactccccaaatctttttctagtgtgtcgacttccttttgtgtgccccagttcttctgcctctttccctcacagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359991 - DNA, 1587 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359992 - DNA, 1563 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359993 - DNA, 1038 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccacccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359994 - DNA, 1509 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccacccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtcaaaaaaaaaaaaaaaaaaaaaaaaaaaaaaaaaaaaaaaaaaaaaaaaaaaaaaaaaaaaaaagaacaaaaaaaaaaggggggcgccgacacagaaaccccaccagaggagcaccaaataagcgcacacacaaattacagtacaaaaaggagcacacagaggggagacacaaaaaacgaagaaagacgcccagcctaaacaaacagcgaccgcgaaagaaaaaaaaacgcagaccagagcacccgtggagaaaaagaaccaccatcactagcaggagaaaaaagaaacatagaagcggagaaaaaacaaccccgtaacaaaaaaatatataacaccctctagaggaaaaaaacaaaacagtaacacaaagcacaaaacaaatggaaaaaaacacaacaccgaataataaagccagcgataaaaaacattcgaaccccaaacgggatattcaatgacgacaaatattaccagg

SEQ ID NO: 359995 - DNA, 1687 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359996 - DNA, 1803 bp, Homo sapiens
cacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccggaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggcagggtctctgtcacccaggctggagtgcagtggcacaatcacagctcactgaagcctcagtctcccaggctcaagcgatcctcctgcctcagcctcccgagtatgggagtacaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 359997 - DNA, 4709 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 359998 - DNA, 875 bp, Homo sapiens
  misc_feature (37)..(37): n is a, c, g, or t
taacatatacgaactcgagctggtaccctatgcgtgnacaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 359999 - DNA, 673 bp, Homo sapiens
tagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcactctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360000 - DNA, 1085 bp, Homo sapiens
  misc_feature (3)..(3): n is a, c, g, or t
  misc_feature (24)..(24): n is a, c, g, or t
  misc_feature (43)..(43): n is a, c, g, or t
atntttttaactggaaatttctangtgtggctgtaatccttgntattcagaagctgaattaggaggatcacatgaatctgggaaggcagaactgcagtgagccaacatctcaccactgcactgcagcctgggcaacagcgagacccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcaggtgggtgtcggcaccccagccccctccgctccgggcccggcgtcccctcccccgcggcccgcgccgccgtccccgccccgtgacccgccgggctacccggggtgggctgggggccggcagcgcgggggagactcgctcgggcctgagccccgaggctcggccggtgggcgcaccggggtcctctgggattgtcaggcctgtccagcctcccgcagcatccccgccccctcccccggcggtcaagatggagggagcgggcggcctcccctccccacgcgtgttgggaggggttctcgggtagcggcgatggtcagccccggctcccccttccgcacgatcctccgcccgcagcgtggggatgctcgggcagctcctccactcccggtttaggtgtgaacgttggaggggtctggaggctgtggtggcgttttccggaacatgtccccctccatgggggacatctctggaggggagaagttagggccgcgtcccccgtgccggttaaaggggtaggcaccgggctcctccggaatcatcagggtctgtcggggctctctccccgccccctccgagtcctgggaaagatcggaggacggggtggagacaagtgggccttggcccccgcacccctctgcgttcgtgtccgaggcggcggcgggggctcccgaactcccctgaaatcgtggggctc

SEQ ID NO: 360001 - DNA, 1252 bp, Homo sapiens
caggttcaagcggtttttctgcctcagcctcccgagtaggtgggactacaggtgtgcgccaccacgaccggccaatttttgtatttttagtagagacggggtttcaccgtcttggccaggctgatctcgaacttctgaccttgtgatttgtctgcctaggcctcccaaagtgctgggattacagatgtgagccaccacgcccagcctcacatctactcttctaatccatctaattttgttttatggtgatgcttttacctttcagaaacagtaataatacaacttttccgactaactagagccattaggaagaattagatccagaatccttttttgatttgtttttggtagtttaatgcagataagtaagaaaatatagttaagttaaaaaaaaaaaaaatgaaaagcatccataatccctccacctgacaactgccttttaacattttgatgtgtatccttccaggtgtatttaaatacactcaaataccctacccctttatgtagacatgttttaataagaaataatattcatgtttatattcttgctatgatcctaaatttttggatccattactagataatctttcaggataatgacatttccattagtaatgtttttgcaaaattgtgtgtctattgaattaaacttgtaaaatagttttattttggtacatgatttatatcaaggttgttcagtagaatgccatgttggtgtttttattagataatgattttattccttttacttttaagcaagtcagcatgacaacttgacacctaagtacagaagaacagtgtcttccggtttagtcctttcttttaaaattctgtagcagtgtttaaagtgcttgtcatctcttatgaaaatgaattatgcatgaatacaaaaagaaattactaatatgtcaacctttccagaaaatttggaaaatgcacacctcaaaaggctaatttacctttctatttcccaaattcagcatgtcccaaattaccatacaacaaggagacaagcccttctttctactttgccagtgagttgggttttttatactaatttttaattgtacagtaaaacactttttaaaggatacatgttaagggagtagacttgttgaacaatattttccttgtgccagtcaaattattgaaagtacttatatatataaataattcagtttttaaaatggaaatacccaatttaagaaggctggagttaatgaaaaatggagttgtttcagaaatcaatttt

SEQ ID NO: 360002 - DNA, 1153 bp, Homo sapiens
  misc_feature (6)..(6): n is a, c, g, or t
  misc_feature (32)..(32): n is a, c, g, or t
  misc_feature (40)..(41): n is a, c, g, or t
  misc_feature (54)..(54): n is a, c, g, or t
  misc_feature (299)..(299): n is a, c, g, or t
  misc_feature (306)..(306): n is a, c, g, or t
ttatgnacgcgtgcatgtgtatctgtataagntacttctnngtaggatacttantatcaaagcaggtgtgctaagggtgcattttgaatatcccggaaggtagctgtgaaatgatttttcttcttcacccttagttctggttcaaggtatctctagaaaaagacaagactgagctattctctttggtggattagagatctgcttcaggaggaggaaggttggccagagttgggcagcactgaaattccacatcctcgggttgacaccgattctaaatgatcaaaggcagaagatttatnccagatnaagccatatggattgctggtctaaaattcaaggcagtttccacgggctcccttgctcagcagtatgcgcaccctaacgctaccctgcacccacatactccacaccctcagccttcagctacccccatccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctctcttgttggactttatttccatgtaacattttccccatcccccttaacaaagatactgctccctatgcactgtgttctgcctctttttgactgccacgtcaacccctccccctctaacctgttattctgaaagcaatactggtgg

SEQ ID NO: 360003 - DNA, 520 bp, Homo sapiens
cggagtttcgctcttgttgcccaagctggagtgcaatggtgtgatgtcggttcactgcaacctccacctcccgggttcaagctattctccttccccactctccctagtagctgtgattacaggtgcctgccaccacgcccagctaatttttgtatttttagtagagacagggtttcgccgtgttggccaagctggtctcgaactcctaacctcaggtgatccgcccgcctcggcctcccaaaatgctgggattacaagcgtgagccaccgtgcccggctccatttctcccaatttcaaattcaaggaggaaaagaattcctgattaaggtacttctttcagatcttttgagctagaacaaaaaaacaaagggaaatatttctaattaactctttttaaattttgtttacaacgtatgatacatattttacacatcctttgtggtttttgttcgtcttgtttttaatcaatgccttgcaagtttaccggtatttaggtagggaaaggattttgtttttgtt

SEQ ID NO: 360004 - DNA, 3900 bp, Homo sapiens
taaaatatttcaaccatttttaagcattgtgagctaatagagggatgtggtggtttgttttttcctcttaaaaattattattaatgtacttaagacaaaccatagaaacaaaaaacatttagatatgaggatttttaaatgatggaatggataatagatcatatgcctgggaaaaagggtatgattctcttgagattatttttgtcaaaggcatataagaactggtaccttgatgagctaaagaattcctaacaaattttattttgtaaaggtttggagtacttacttgtgtttttcattttagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360005 - DNA, 4690 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagagttaaatacctagaattggaattgctgaggtatgtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360006 - DNA, 2902 bp, Homo sapiens
ctgggcatggtggctcatgcctgtaatcccagcactttgggaggccaaggtaggcagatcacctgaggtcaggagtttgagaccagcctggccagcatggtgaaaccccgtctctactaaaaatacaaaaaaattagctggttgtggtggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacctagatcttcagagaagcctgaagcctcttttaggaagtaacatttgaactgagaatgtaataaatacattttccctttcttctagttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360007 - DNA, 4457 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360008 - DNA, 5545 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcaggtgaggcgtgtgtgtgcaggggccgccggggcaccccaaagcattctgctcgcacaggtggaatggcaggcagggccagtgcttcaagccccgcatttgagaactagcaagacccgtccaggagtgtgcacaggagggactgtgacgatcagttcagcatcagggcctgaggcttccgggagccgagtctgtgtgtgttctgatggtatacaggatttggcttgatgagaagcagcagcagcagcaacagcagcctgatgcatgcctaggactcagttggccttccttgttatgacaggctggacagggcagtgttttccttcctgagtcccaaaagtctgacatgtggggggttattaccatggcagagtttgattgtagctctggagaagatactgctgagaaagcgctgtggatggactggctttgagtgtagcgttagccccagcccctgaacaggggagagcgccctgtgattgtgctctactacttgatggctgccatggcgatacttcacagtctgacctgttattctgaaagcaatactggtgcttggctaatatttggggagggggtttgttaaggcctttttttctaccccatgaacaagtcttctgggagttttatctgaagtggttttacgtctgactggtttgtttctacccacccacccaaccctccccactttggtgcagatgggagggggaaaagcgaattcaattttgagttttgttcagctagcacgaggatagtttacaatcatgtgctgcagagacactaggctgatgtgtggtgttgccagttttctgtttcaatgttcgcttttctttttacagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360009 - DNA, 2231 bp, Homo sapiens
  misc_feature (172)..(172): n is a, c, g, or t
cccatctttactaaaaataaatattaaaaaaaattagctgggcgtggtggcagtctcctgtaatcccagctaatcaggaggctaaggcaagagaatggcttaaactcgggaggcagaggttgcagtgagccaagattgcactgctgcactccaacctgagcaacagagtggngactctgtgaaggaaaaaaaaaaagtattttttgattgcctttgagaggaacggttgtatattactcagatttttaaaaaattgttcttttatggctgtattctttaagggattaaggaatgggcaatataagtgtatatgtttcaataaaaacgattagtgatcttctagtgagaacagtttaaatctatatttagcaattttttttaaattgtcaggtatggaagattttagagcaacgtaaagtccatgtagatttcactggcctttatattttttttaggcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360010 - DNA, 1519 bp, Homo sapiens
agtctgcttttttttctgcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360011 - DNA, 1716 bp, Homo sapiens
gccacgttccttctctcagccccaaagccttctactaccccaacttcacctcggcctcaagcacaacctagcccatctatggtgggtcatcaacagccaactccagtttatacctttatacccaatacctatgacgcccatgccagtgaatcaagccaagacatatagagcagccttggaacatatgaacctgttgaaagaactctgcctgaaataattaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360012 - DNA, 1780 bp, Homo sapiens
gggggcacaaggggctgtgaaagattcagaacaagtggaacctcttaggcttgggaaagtaaactgagtggcagaagggctcctgtgattagctgagagagactgtggtccttcggccctgatgatagatccctggccttgccacataccatacacagtgcccgcacccccatcccccaccacacccaatatagtctgtgccctcaggacattgctccagggcagtagcatggtgaggttagcctgatgatggccttgagctaaagagtgtgcacctaaaatgcacttgtgagtagtttctgcctatgccttcaagttgcctgggaaaacctagtgaccgttaagagtaaatgcaaactaatttgattttaatatcatatgtagagctgtattatatgaaccaaatgctagtctgttaagcaatagctacacttattttttcaagacaatggatggtttaaatggagtcatctatagaaattggtagtggcgtgagttatgcattgtaaccatcaagaaagttcagttgatgaagtgtagaggagcgatggaggttgtcacacatcggttgtgtacatgctcctttttctttcactttagtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360013 - DNA, 2214 bp, Homo sapiens
caggttcaagcggtttttctgcctcagcctcccgagtaggtgggactacaggtgtgcgccaccacgaccggccaatttttgtatttttagtagagacggggtttcaccgtcttggccaggctgatctcgaacttctgaccttgtgatttgtctgcctaggcctcccaaagtgctgggattacagatgtgagccaccacgcccagcctcacatctactcttctaatccatctaattttgttttatggtgatgcttttacctttcagaaacagtaataatacaacttttccgactaactagagccattaggaagaattagatccagaatccttttttgatttgtttttggtagtttaatgcagataagtaagaaaatatagttaagttaaaaaaaaaaaaaatgaaaagcatccataatccctccacctgacaactgccttttaacattttgatgtgtatccttccaggtgtatttaaatacactcaaataccctacccctttatgtagacatgttttaataagaaataatattcatgtttatattcttgctatgatcctaaatttttggatccattactagataatctttcaggataatgacatttccattagtaatgtttttgcaaaattgtgtgtctattgaattaaacttgtaaaatagttttattttggtacatgatttatatcaaggttgttcagtagaatgccatgttggtgtttttattagataatgattttattccttttacttttaagcaagtcagcatgacaacttgacacctaagtacagaagaacagtgtcttccggtttagtcctttcttttaaaattctgtagcagtgtttaaagtgcttgtcatctcttatgaaaatgaattatgcatgaatacaaaaagaaattactaatatgtcaacctttccagaaaatttggaaaatgcacacctcaaaaggctaatttacctttctatttcccaaattcagcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360014 - DNA, 4203 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagagttaaatacctagaattggaattgctgaggtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360015 - DNA, 2168 bp, Homo sapiens
tagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaagtttgggcgtcctcaccctgcaaagtttaggttctgtggtgtagcgcactgcagttgatttgctttttgatagtggggagggaagccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360016 - DNA, 2083 bp, Homo sapiens
tagatgtctctgctactttcataacagaactctctgaggcgggtctaagtgagacctgccacaatgaattccatttcctgttaaatagtgcgccagtgaggctctggcaaggtgtgggctagagatgcgactcagttggatctatctctcagaaggctaccttgtaagtagagttccacagctctgggaaccggtttggtccgtgtgggccagcgtggtttggtggagtcagcttcataagagctggggtcctgtaggtgtctaccagaggctggtggctaagtaggcatgtgaacttacatgtaagtcagggatccctaaaacctcactctgtttttgtgctgaaagggcaaaaaggttaacacagggaagctcaaatttgccatgtgcccgtttgaatatgtgagagtaaaaacggcatttcatccaaggcttatcgtagtctagaacagtgcacagtgtgggaaaaaggaaacaagggctcttcctggccctgccaaccccctgcagagctggaatccagctgtttgggctgactaaaatcacctttccaacttgacagtgagtgagaccaggttgaacttggtacagagacgctgggctggcccagatgacttcaggttactcctttccatctcactggagccattaaaaactccaactcctcctcctcctcctgctccatcagcatatctctgagagagtcacgggggcctaagagtctcttttcactgcctggtgagcagaccagaagcagagggagagaggcaaatgaacagaggtccaagtaattcacatacttgactgtgacagtctctgcttattaatgtaatctgttttcctatttgaaagggatgttatctgcaaaactacctcaggccccacatggcagcctgattctgaagcatcattgaatcttgtatgatattaagttgagaaagctgcccttggatccagtgtctaatctttgtgaagatcttaccccatacatagaatacaatgatcagaaatgtcaagggttaggacagcacagccctgacttctacccaggctcacttgttgcctgctccctgacccttgcaggatctgcccaaaggtgaagcgcgtcttcaggtcaatagataatctactagagattgtccccagagaacagaactgggccctgaggcccaccgttgccctttcctgagagtcccagcccagtgaaaggaacacagttgacatgttgttgaagccggagatgttgcctgtatgcgtaaaagagctctctgtttcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360017 - DNA, 3764 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatggtaggaagcactttgtttgtctcttccagtgtgtgtgactcttcttaatttaagtttctgaaaacatactctatctaagaataacctgaccttttatgacattgagggtcaagaatctgaaggaaaagatgaacccatttctttgcctgacttgctttataacttttggcaaatagtttctacttctgtacctggtcttcagatctctttcctgctttaactaaaatgtaatgatgtatataatggcaaagcatctttgtggagaaaggtacctttctcctcttcctca

SEQ ID NO: 360018 - DNA, 2601 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtgggggtaggtaacacttgggcataatgatggtactcattttgtcattacactagatataaagagggctgagctacaactctgtttgaggaagtgtaagtatgtatatgttaaaaatagtagaatcaccaggaattgggaaacccatatttttattctgggctctaccacttattcatcatatattaaagcaagtcagacactcattctgaagttgagatttcgcagtgagtaaagtgttaataattcttgcctagtctacattatgggattgtgatgagattcctataaggttcataaatacagatatattgtaaaactataaagttttgtaaagtacctctctaatatgaggcaaacacagtatgtaacactatttggagggaccgtatttccttatctttttagca

SEQ ID NO: 360019 - DNA, 1581 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcaggtgggtgtcggcaccccagccccctccgctccgggcccggcgtcccctcccccgcggcccgcgccgccgtccccgccccgtgacccgccgggctacccggggtgggctgggggccggcagcgcgggggagactcgctcgggcctgagccccgaggctcggccggtgggcgcaccggggtcctctgggattgtcaggcctgtccagcctcccgcagcatccccgccccctcccccggcggtcaagatggagggagcgggcggcctcccctccccacgcgtgttgggaggggttctcgggtagcggcgatggtcagccccggctcccccttccgcacgatcctccgcccgcagcgtggggatgctcgggcagctcctccactcccggtttaggtgtgaacgttggaggggtctggaggctgtggtggcgttttccggaacatgtccccctccatgggggacatctctggaggggagaagttagggccgcgtcccccgtgccggttaaaggggtaggcaccgggctcctccggaatcatcagggtctgtcggggctctctccccgccccctccgagtcctgggaaagatcggaggacggggtggagacaagtgggccttggcccccgcacccctctgcgttcgtgtccgaggcggcggcgggggctcccgaactcccctgaaatcgtggggctc

SEQ ID NO: 360020 - DNA, 588 bp, Homo sapiens
attaagagaatcgtttcaacatgaaaactaaaataactttggagaagtttggatcacctctgcaaaaatgctatactatttactatagcattatatagagagaaataaaataactgtgccagtgtggagaaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggcctaaaagaaaaaaaaaaaacaaaaaaaaaaaaggggggggggcaaaaaaccccggggggcaaagtacccgcccgtttctggaaagggccccaggacgaaaaaaagcagggcgacaggggggaagccgggctgaggacccccggggggaggaccccaaatagcgggaaaatggttggaacttcggggaagggta

SEQ ID NO: 360021 - DNA, 548 bp, Homo sapiens
ccttggaatcgttgaatatgagggaaagcgttggcttctcccttctttctcccaaacattggaagtatttttggctgttaaaaagcaccccttgttccatgtggaatcccttgtttaaaagaagtaaaatatgtacctcctgtcctccacagacctgaggaccagtgtgatctcaagaaggttacaggtaaatgtagatgtctctaactgaaaggtggcttttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttc

SEQ ID NO: 360022 - DNA, 532 bp, Homo sapiens
tggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacctagatcttcagagaagcctgaagcctcttttaggaagtaacatttgaactgagaatgtaataaatacattttccctttcttctagttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgagggtatgtaacaaagggcttctggatccataatctcagc

SEQ ID NO: 360023 - DNA, 4648 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaataccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360024 - DNA, 912 bp, Homo sapiens
gccacgttccttctctcagccccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtagagacagggtttcgccgtgttggccaagctggtctcgaactcctaacctcaggtgatccgcccgcctcggcctcccaaaatgctgggattacaagcgtgagccaccgtgcccggctccatttctcccaatttcaaattcaaggaggaaaagaattcctgattaaggtacttctttcagatcttttgagctagaacaaaaaaacaaagggaaatatttctaattaactctttttaaattttgtttacaacgtatgatacatattttacacatcctttgtggtttttgttcgtcttgtttttaatcaatgccttgcaagtttaccggtatttaggtagggaaaggattttgtttttgtt

SEQ ID NO: 360025 - DNA, 4655 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360026 - DNA, 4445 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360027 - DNA, 4700 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagccttggaacatatgaacctgttgaaagaactctgcctgaaataattaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360028 - DNA, 4372 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagagttaaatacctagaattggaattgctgaggtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360029 - DNA, 4540 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360030 - DNA, 1927 bp, Homo sapiens
cccggaagccggccggctgaggcgcacgtcacccacttgttgttcacagaatcccttttctctaggatatagttggtgatttcagaacctccatcatcctttggaggagcccactttaaggtcatggcttctgctgtgacttcatcaaatttgattggtccagtggggatgccaggcttgccaacaacctttatggagatagttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgtttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360031 - DNA, 1405 bp, Homo sapiens
tcatcgagctcggtccctagttttagaagtttcaatagcagcacaacagactgtctttacgatccatccttctcacgttcagccggcgtataccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaagttagt

SEQ ID NO: 360032 - DNA, 4244 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggtaataccagctttagccaactttctgtgaaggccaagtagaatgtgaaggttatcagtaagcagctagaggctctcccagctaggaaaccctgtgtgtcatgccatttgcctgtctccctttccctctcaaatacacgtgatctggcctaaaagaaaaaaaaaaaacaaaaaaaaaaaaggggggggggcaaaaaaccccggggggcaaagtacccgcccgtttctggaaagggccccaggacgaaaaaaagcagggcgacaggggggaagccgggctgaggacccccggggggaggaccccaaatagcgggaaaatggttggaacttcggggaagggta

SEQ ID NO: 360033 - DNA, 3318 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaaaggtgagaataatcctgcctgtgtttgcttgtagtttgcatgctgcatgaattgagtaactaagtttataatgaataaatagttgtagtttagctctgactttttgatgaggctatgcattggcttttgatgaacaacattacatagatattcacatg

SEQ ID NO: 360034 - DNA, 1480 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcgtccttctccccctcgccagcccgggcgcccctccggccgcgccaacccgcgcctccccgctcggcgcccgtgcgtccccgccgcgttccggcgtctccttggcgcgcccggctcccggctgtccccgcccggcgtgcgagccggtgtatgggcccctcaccatgtcgctgaagccccagcagcagcagcagcagcagcagcaacagcagcagcagcaacagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagatactcagaagattttaaacggaaggtccggtgatg

SEQ ID NO: 360035 - DNA, 470 bp, Homo sapiens
atgatgtatcgtgtcttatctcattcttcagtaactcctggctcgctctctacacataaaatgaaactgcagtcatacaagtatagatttgaggattacctgaatagaagtgatcaatgaagctgtaataatgagatttcagaattaagaaggctaagaagtgagttggttatgccttttattagaagcaggtggaagaaaggaattgatggagtagaagagtggcttgggaaatatggacagtttctttcctgattagccaaaggagcttggaatgaagtgggggtatttggtcattaagagatcaccagtcacttcaaagaaagtacttttcagtaaactggaagctacaaccagatttcaagaggttaaggatgcatgggtgataaagggagaaagatattataaaactaccttttgaagttctcaaggtggaaagaagggaaggaaagaattgaggggtaataggg

SEQ ID NO: 360036 - DNA, 512 bp, Homo sapiens
tacagaatatacaattacctcatatagttaaccatctaagagtttgcatcttattgtatataaatcatacttcagtaaatccttgtctctctcaaaaaaaaaaggagagtttagtaatagaagtatagatttgaggattacctgaatagaagtgatcaatgaagctgtaataatgagatttcagaattaagaaggctaagaagtgagttggttatgccttttattagaagcaggtggaagaaaggaattgatggagtagaagagtggcttgggaaatatggacagtttctttcctgattagccaaaggagcttggaatgaagtgggggtatttggtcattaagagatcaccagtcacttcaaagaaagtacttttcagtaaactggaagctacaaccagatttcaagaggttaaggatgcatgggtgataaagggagaaagatattataaaactaccttttgaagttctcaaggtggaaagaagggaaggaaagaattgaggggtaataggg

SEQ ID NO: 360037 - DNA, 5207 bp, Homo sapiens
gaatttcatttcttccactaaagcgtttgcggagacttcaagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccatttttttttttcagcttaagtaaccacacaattttaggcctcaattttttttttttcctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatga

SEQ ID NO: 360038 - DNA, 1229 bp, Homo sapiens
gaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccg

SEQ ID NO: 360039 - DNA, 5620 bp, Homo sapiens
gaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccatttttttttttcagcttaagtaaccacacaattttaggcctcaattttttttttttcctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatga

SEQ ID NO: 360040 - DNA, 5569 bp, Homo sapiens
gaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccatttttttttttcagcttaagtaaccacacaattttaggcctcaattttttttttttcctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatga

SEQ ID NO: 360041 - DNA, 953 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattg

SEQ ID NO: 360042 - DNA, 798 bp, Homo sapiens
  misc_feature (798)..(798): n is a, c, g, or t
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgtccgctgttccgtctctggacggtgaacattagggcctgttctggtctgtn

SEQ ID NO: 360043 - DNA, 873 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattg

SEQ ID NO: 360044 - DNA, 1007 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagtgtgatgtatctacttccaggttcttgtataactgccacacgtttctgcttgatatatacctatcaaaagcttgacagtagtaaatacttatgcaggaggggctggccagatgatgagtgagctcttctccctctttgttctagcaatgaatcacaaaacagattgggtttccatccttgaatcagatcctaggaagatcagagttaaatttggacccaattttttagcttttctttttcaatttctttgcttccatatttaaatgtatcttaaaaacttttttaaagccac

SEQ ID NO: 360045 - DNA, 936 bp, Homo sapiens
ccatggaaagaaccattgaatgttacacattaaacaagtctaatatcattagaattactttcctaattagatgacagttgtgcagaagattctgaccttatttgaggcttacatataggtttggagatgtggaaaggagtggaaaaagaaatatgtaagctgaagtgccaaactcacactgaaataaagggcatggcctaccagctgacaaggagtgtctggtttcaagatggcaaatgaccctaaacatgatagacaaatatgttttacataggtacatgcacagataggcacatataaatccacatttgcaagcaaaaagtggaacctgtaaagcagaatttctgaggaatctctaaaagactaatactatatggaatttgaagaggaaacccagagcagaagcacatagtgaagtactgccacaaagatgtgtgacgccactaaaggtgctctagacccacaagaaaggaaaactgggagcaggacaactatctggatattgactgcacatgccaatatctcagtcagactaacagaatcagagctttaggcagagaaatgaatggttggagagagaaggcaatgcccaggtgccctgctttgaaatgtcccgcccatccccaaattagtctgaaaatttcaaatgttgtataaattcccttcccatcaaaagtgtcccataaacagcagtggtagaagagttttaactgagtatcacagcttcaatgatgagtatagaaaactccaaaaatctgaataccaacacaatcaaaaaagaggtacaaaccacaagtggaagaaccatctcaagaaataatgaagcattcatggaatacagattagcaactctttaaaacagtattgccaagagaaacaggtaagaggccctctggagaaatgtcagaaatagaaaatgtaattgttcaaatgtta

SEQ ID NO: 360046 - DNA, 1809 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccattt

SEQ ID NO: 360047 - DNA, 3291 bp, Homo sapiens
acctcagttcctcccctccccccacgtaacgtgtggtcttccatcacttaggacccggaagcgacctaaatctttaggacatttcttcactttcagctagagaaactgaggcccaaggggagaagcatgacttgcccaagctcatatagctagttagtggcaaagctggggaaacagacttctctaacgatttaagttggcacctgcggttaggttcccgagttctgccacttgctgggttaccttggacaagccactaacctcattgagcttcagtttcataatttgaaaaatggaactactaacagaacctaccgcttaggcatcttggaagatgaaatgagcgagtacatgagaagtttacagtgcctggcgtatattaagttctctataattgttaattacatcattattacaattctgattttcctgtctattttctcttcaggcaccctgctcttcagggaggtcaggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360048 - DNA, 2957 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360049 - DNA, 3091 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360050 - DNA, 3055 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagattggagtgcagtggcgtgatctctgctcactgcaatctctgcctgccgggttcaagcgattctcctgcctcagcctcctgagtagctgggattacaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360051 - DNA, 2495 bp, Homo sapiens
aggaaggctgaagaaagttcttttttataaaagaatatgttgaatttcagccctttggaagatcattaagtttcacggccttggaagtgagaaatttttccaaaatacggaattaaaaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360052 - DNA, 2129 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgtcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360053 - DNA, 1288 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagtgtgatgtatctacttccaggttcttgtataactgccacacgtttctgcttgatatatacctatcaaaagcttgacagtagtaaatacttatgcaggaggggctggccagatgatgagtgagctcatatccttttgatcgcttgtggaattgctttgtactaaactgtgctttgccagtatactattcctgcttttatgccagaggtagcaaattttttgtgtgaaaaatcagaccttggcgatgaccttaaacagcaggatatgaagaactcccacaagcttagcgttccaataatggaacactaggcataaatgggttaactgaagagaatatttgcagtgttaaccctataaaactcacctttataatttctgtgaggaatattgttagaaatgttgtcatacatgaagtgacactatctgtctggaaaaattttcctcagcctgtggttctcccacttctccctctttgttctagcaatgaatcacaaaacagattgggtttccatccttgaatcagatcctaggaagatcagagttaaatttggacccaattttttagcttttctttttcaatttctttgcttccatatttaaatgtatcttaaaaacttttttaaagccac

SEQ ID NO: 360054 - DNA, 1033 bp, Homo sapiens
aggaaggctgaagaaagttcttttttataaaagaatatgttgaatttcagccctttggaagatcattaagtttcacggccttggaagtgagaaatttttccaaaatacggaattaaaaggtactaccaaggggggaaaatagataaatctaattgacctaattattacattattctttagaacctacatattatttagttgttccttgtaagaacttgctagaaccatttttgatgaaaatctaggcctgatacctctttggctatctgtatagaagtaaaaacttttttttacttttttttttttttcagatagctagtctagcatagtcaggctcctgaggatgccagcccttctggtagcactgcaagtgattaaagcttacatgactgcttttcttccacagtgtgatgtatctacttccaggttcttgtataactgccacacgtttctgcttgatatatacctatcaaaagcttgacagtagtaaatacttatgcaggaggggctggccagatgatgagtgagctcatatccttttgatcgcttgtggaattgctttgtactaaactgtgctttgccagtatactattcctgcttttatgccagaggtagcaaattttttgtgtgaaaaatcagaccttggcgatgaccttaaacagcaggatatgaagaactcccacaagcttagcgttccaataatggaacactaggcataaatgggttaactgaagagaatatttgcagtgttaaccctataaaactcacctttataatttctgtgaggaatattgttagaaatgttgtcatacatgaagtgacactatctgtctggaaaaattttcctcagcctgtggttctcccacttctccctctttgttctagcaatgaatcacaaaacagattgggtttccatccttgaatcagatcctaggaagatcagagttaaatttggacccaattttttagcttttctttttcaatttctttgcttccatatttaaatgtatcttaaaaacttttttaaagccac

SEQ ID NO: 360055 - DNA, 509 bp, Homo sapiens
ctggacctagatttcctgatttttagatgttaactttttatatacagcactgtatgctttttgtgggaaaatagtgttttttgtaaatgaatttaaataaatccttgtcttcaaaataagaggaaactacctatactgaattagaactatttaaataatgatttgtgtgatggccaaagagttcttatcagaagtggcaaaaactacatacaggttggcttccaataacatgagccaggtatttttcagtaatattttgaagtgtcttttctttctagacatgcacatgatggtgtccaagccagaacagtgggtaaagccaatggctgtagcaggagccaatcagtacacctttcatctcgaggctactgagaacccaggggctttgattaaagacattcgggagaatgggatgaaggtaagaaatcgtgatgagagtgttttgtaacattcactctcagttgggaagatttgcgggaaacaggaaattttctctttttttgatacag

SEQ ID NO: 360056 - DNA, 2559 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaact

SEQ ID NO: 360057 - DNA, 1007 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattg

SEQ ID NO: 360058 - DNA, 3037 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360059 - DNA, 2981 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360060 - DNA, 2916 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcagttgtgcagaagattctgaccttatttgaggcttacatataggtttggagatgtggaaaggagtggaaaaagaaatatgtaagctgaagtgccaaactcacactgaaataaagggcatggcctaccagctgacaaggagtgtctggtttcaagatggcaaatgaccctaaacatgatagacaaatatgttttacataggtacatgcacagataggcacatataaatccacatttgcaagcaaaaagtggaacctgtaaagcagaatttctgaggaatctctaaaagactaatactatatggaatttgaagaggaaacccagagcagaagcacatagtgaagtactgccacaaagatgtgtgacgccactaaaggtgctctagacccacaagaaaggaaaactgggagcaggacaactatctggatattgactgcacatgccaatatctcagtcagactaacagaatcagagctttaggcagagaaatgaatggttggagagagaaggcaatgcccaggtgccctgctttgaaatgtcccgcccatccccaaattagtctgaaaatttcaaatgttgtataaattcccttcccatcaaaagtgtcccataaacagcagtggtagaagagttttaactgagtatcacagcttcaatgatgagtatagaaaactccaaaaatctgaataccaacacaatcaaaaaagaggtacaaaccacaagtggaagaaccatctcaagaaataatgaagcattcatggaatacagattagcaactctttaaaacagtattgccaagagaaacaggtaagaggccctctggagaaatgtcagaaatagaaaatgtaattgttcaaatgtta

SEQ ID NO: 360061 - DNA, 3055 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggattttgtttgtcttgtaggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360062 - DNA, 3068 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggagttacttatttcctcatgtatatatctaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360063 - DNA, 3011 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360064 - DNA, 3036 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttact

SEQ ID NO: 360065 - DNA, 1910 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattgtctaattttacgctgtagcagaaccagatggctgagaaaattctggaactatggatcttgaccccaaggatatattattttattccaagaaagatcagttgtgcagaagattctgaccttatttgaggcttacatataggtttggagatgtggaaaggagtggaaaaagaaatatgtaagctgaagtgccaaactcacactgaaataaagggcatggcctaccagctgacaaggagtgtctggtttcaagatggcaaatgaccctaaacatgatagacaaatatgttttacataggtacatgcacagataggcacatataaatccacatttgcaagcaaaaagtggaacctgtaaagcagaatttctgaggaatctctaaaagactaatactatatggaatttgaagaggaaacccagagcagaagcacatagtgaagtactgccacaaagatgtgtgacgccactaaaggtgctctagacccacaagaaaggaaaactgggagcaggacaactatctggatattgactgcacatgccaatatctcagtcagactaacagaatcagagctttaggcagagaaatgaatggttggagagagaaggcaatgcccaggtgccctgctttgaaatgtcccgcccatccccaaattagtctgaaaatttcaaatgttgtataaattcccttcccatcaaaagtgtcccataaacagcagtggtagaagagttttaactgagtatcacagcttcaatgatgagtatagaaaactccaaaaatctgaataccaacacaatcaaaaaagaggtacaaaccacaagtggaagaaccatctcaagaaataatgaagcattcatggaatacagattagcaactctttaaaacagtattgccaagagaaacaggtaagaggccctctggagaaatgtcagaaatagaaaatgtaattgttcaaatgtta

SEQ ID NO: 360066 - DNA, 607 bp, Homo sapiens
tttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaat

SEQ ID NO: 360067 - DNA, 2198 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360068 - DNA, 3813 bp, Homo sapiens
  misc_feature (1235)..(1235): n is a, c, g, or t
  misc_feature (1408)..(1408): n is a, c, g, or t
  misc_feature (1527)..(1527): n is a, c, g, or t
  misc_feature (1799)..(1799): n is a, c, g, or t
  misc_feature (1978)..(1978): n is a, c, g, or t
  misc_feature (1985)..(1985): n is a, c, g, or t
  misc_feature (2071)..(2071): n is a, c, g, or t
cgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtcagctcctccccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatangttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcnaccttcccaccggtgtccgtgcccttttctgttctgcatgagcccgggaggtgtgctcctctttctggccttgctgaggaagcctcctcagtctgttaattgtctcttcctgggtaatntctttattagagaaatctttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttcatgttggtcaggctggtctcaaactcccaacctcaggtgatccgcctgcctcggcctcccnaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcntacaggngcacatcaccacgcccagttaatttattataataataataattattttgagacggaatctcgctttgtcaccaggctggagtgcantggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctac

SEQ ID NO: 360069 - DNA, 494 bp, Homo sapiens
ttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttct

SEQ ID NO: 360070 - DNA, 2287 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacggtagatttcatgctttgttttccctctctctctgattttaaaatgtgaactgcagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360071 - DNA, 2980 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagccta

SEQ ID NO: 360072 - DNA, 4339 bp, Homo sapiens
  misc_feature (1359)..(1359): n is a, c, g, or t
  misc_feature (1532)..(1532): n is a, c, g, or t
  misc_feature (1651)..(1651): n is a, c, g, or t
  misc_feature (1923)..(1923): n is a, c, g, or t
  misc_feature (2102)..(2102): n is a, c, g, or t
  misc_feature (2109)..(2109): n is a, c, g, or t
  misc_feature (2195)..(2195): n is a, c, g, or t
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatangttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcnaccttcccaccggtgtccgtgcccttttctgttctgcatgagcccgggaggtgtgctcctctttctggccttgctgaggaagcctcctcagtctgttaattgtctcttcctgggtaatntctttattagagaaatctttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttcatgttggtcaggctggtctcaaactcccaacctcaggtgatccgcctgcctcggcctcccnaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcntacaggngcacatcaccacgcccagttaatttattataataataataattattttgagacggaatctcgctttgtcaccaggctggagtgcantggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360073 - DNA, 2281 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggtaggtcagcggggacagttgtcgtgttacaacatggtgcttgttgactttggatcccagttgtagccagggacgttttcaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360074 - DNA, 2847 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcacttttaacttttgtcctcagccattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360075 - DNA, 4285 bp, Homo sapiens
  misc_feature (1359)..(1359): n is a, c, g, or t
  misc_feature (1532)..(1532): n is a, c, g, or t
  misc_feature (1651)..(1651): n is a, c, g, or t
  misc_feature (1923)..(1923): n is a, c, g, or t
  misc_feature (2102)..(2102): n is a, c, g, or t
  misc_feature (2109)..(2109): n is a, c, g, or t
  misc_feature (2195)..(2195): n is a, c, g, or t
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatangttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcnaccttcccaccggtgtccgtgcccttttctgttctgcatgagcccgggaggtgtgctcctctttctggccttgctgaggaagcctcctcagtctgttaattgtctcttcctgggtaatntctttattagagaaatctttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttcatgttggtcaggctggtctcaaactcccaacctcaggtgatccgcctgcctcggcctcccnaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcntacaggngcacatcaccacgcccagttaatttattataataataataattattttgagacggaatctcgctttgtcaccaggctggagtgcantggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtatagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360076 - DNA, 3076 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagccta

SEQ ID NO: 360077 - DNA, 3165 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagccta

SEQ ID NO: 360078 - DNA, 2287 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360079 - DNA, 3718 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcacttttaacttttgtcctcagccattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagccta

SEQ ID NO: 360080 - DNA, 1820 bp, Homo sapiens
cgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtcagctcctccccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360081 - DNA, 1984 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttaggtctacctggccaggtagacctaactattagtggcaggttagttgtttgtagggctcatggtaggggtaaaaggagggcaatttctagatcaaataataagaaggt

SEQ ID NO: 360082 - DNA, 2098 bp, Homo sapiens
  misc_feature (2079)..(2079): n is a, c, g, or t
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagctatgtaactgagtaagacagggagaaatattaatccgtgagtggctcccagtaagaccatggccaaatacatcctgaagtagaatatctgggtcaaacnataatagggatcctctaga

SEQ ID NO: 360083 - DNA, 1371 bp, Homo sapiens
gagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360084 - DNA, 1502 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgactgtcatctcagcggggatcctaatagagtcga

SEQ ID NO: 360085 - DNA, 286 bp, Homo sapiens
ctagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagaga

SEQ ID NO: 360086 - DNA, 1969 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360087 - DNA, 1536 bp, Homo sapiens
ggatgtcccctggtacgggagtggccgtattatacttccgtttgatcaaaccaaaaattatttcagtaattgtaaattccctctcttttactccacgtttaaaccattgagaatttcagtcagctctacttctctccaccttctacaactatgatctagatgaccacaatcatcgttccactcccgtaccctggtacgggagtggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360088 - DNA, 2534 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360089 - DNA, 2856 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagccta

SEQ ID NO: 360090 - DNA, 2425 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgat

SEQ ID NO: 360091 - DNA, 2936 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggtgggccgcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatttgtgcaaaaccagtgaaagatgaacactgggccattttaagatggaaacaaggtgggggttggatagagagttatatgcagcctcttttgcacctcgttggtatttgtaagaccacatttttttctccctaggagatgcctcataaatttgtgatagccgtgctgatggaatacattcgttctcttaaccagtttcagattgcagtacagccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcacttttaacttttgtcctcagccattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360092 - DNA, 1062 bp, Homo sapiens
tttttttaaccgtaaccagaaaggggttgcgaatgacatctagctgtcaggtctttaaagtattgtatttcttagagtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360093 - DNA, 1035 bp, Homo sapiens
gagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgccgaagatcatagtttgtggtttttttctttcaggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactata

SEQ ID NO: 360094 - DNA, 1743 bp, Homo sapiens
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtgggggatagtggaggagtagtaaattcagggtccctgcatcccacgagctggcggctgcatctcacttcataccttcactgtttttgtttttcccatctgtgtttgatcttgcctgtagatccttggtctactgttatagatgagaaaaat

SEQ ID NO: 360095 - DNA, 1552 bp, Homo sapiens
  misc_feature (1348)..(1348): n is a, c, g, or t
  misc_feature (1401)..(1401): n is a, c, g, or t
gtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggctggcactatgtcgaagctgcccaaatttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcccgctcgatcgatccagccctatcagatccccatcacaggtcctgctgccgtgaccagccagtctcctgttccatgtaaactctattcttcatcttggattgtctttcaacctgacatcattatcagcgcaagccaagtacctctggaacctccaagtgaaacttgagcacatagttcagcgtctgacgtcagacgctgaactatgtgttccatttattttgtctctcaaattttaggaatcttctcctttaattaactcatcaacctctcatggcnagaatttgagaaagtaaatttatactcaggttctaattttaatagggaaggangaagttacagctcagtgcaccatgaagttgacacagagatggagacacctcagccccacctctctggaacaggcaagatgattggggacggagcacaggtcagcgtgggacgagggtcatggtggacatgggggtgaggtggtctccccac

SEQ ID NO: 360096 - DNA, 473 bp, Homo sapiens
ctatctcaaaaaaaaaaaaaaaataaggtttgagttggagctagtctgatgcagcagggagccctgttttcatcaccacccctctccccagtctcagggtgtggctgaggggccttggggtccctgatccagcctcctctcttgcatgatgatcaccacccctctccccagtctcgggtgtggctgaggggccttggggtccctgatccagcctcctctcttgcatggtgcctcgcgccccatgctcggccttcagtgctgtcttgaacgtcccaatggagccaccagagtgactttcctaacagaagatatgatctgccttgaggcttggaccccaaacccctgtggggcccgggttaccgtggctcctgcctgtgattccagcacttccggaggctgaggcctgagaatcagttgaggccaggagtttgagaccaccttgggcaacatagtgagatcccagctctacaaaa

SEQ ID NO: 360097 - DNA, 1995 bp, Homo sapiens
  misc_feature (1659)..(1659): n is a, c, g, or t
  misc_feature (1829)..(1829): n is a, c, g, or t
  misc_feature (1849)..(1849): n is a, c, g, or t
  misc_feature (1911)..(1911): n is a, c, g, or t
gacactcttgattaatgtgatccagaaccattgtgaatatccacatttgaaaatgccactattacatgtattttcacctatgaaatgtaaacatgagaatgggtcacaaaccttgctgagatacagatgctaaagagcctgctagatgtattcattaggtacaccattcacatgcgtgcacaagcctcaaagcatgttattcaaatttgtgccttagcaaaatgatgcctgctatacatcatgggtatttggagctcccacaaagagtagaaattgtaaacgttagatccctgaatgtcagtgatctactatagatgtaactattgttggtatgacacttcacacatcagttagaataatatcgcccaactttaagatctaacaatggcttgctgtaatattttattgatgatttttaaagtaagcatactatagctgaattcttctaaattttattttatattcaaatataaaataattactataaaaaacaaaatcacagaatggatccacatatatactgtcatatatgtgacaaaacattcacatatatactgtcaattgatttttgacaaaagcaccaatgcaattcaatggggaaatggaacttcaacaaatggtactagaacatctggatatctaaatgtggtgggagggaatcatgaatttttttcacatagcatacacaaaaattaatttgaaatgtgtcattgatctaaatataaaaaccaaaactatacaacatctagaccaaaacatctaagactatctttgaaagctgggggtaaagaaagatttcctaggacatagaaggcaattataagagaagacaattacaaattgaactttatcaaaattttaaaagtctgctcatgttagtgttaagacaaaaaggcaagccatggacaggaaaaaatatttgtaatatgtttatctgacaaaggactcgtatccaaaatatatacatataaaaaaacacaatattaaaaaatgggcaaaagccttgaacagatactacaaaagaaaatattggaatgtccaataacacataaagagatgttcatatgaaggtaaaatgaagcaggcaaaaaaagaaaagatgttcaacatcattagttatgagagaaatgcaatataaagtcatgaagtaatactttcacatctatcagaatgactaaaatttaaaagactgataaaatgtcaataagaatgtgaaagtcagaactttcatacactgctgctaagattacaaaatggtacaaccactttggaaaactggcaatttctgatacaattaaatatatccttcaacctgtgatccagcaatcctactccaaggtatatacccaagagaaatgaaatcatatgtccacaagaagagttgaacatgaatatcatagcagttctatttataatagccccaaactagaaacaatcccaatgtccttcaataggtaaatagataagtaagttacaatacagtggtattcagcaataaaaagacctactgatacaagcaaaacatgaatgaaaccaaaaatatgacatataaacaagtacttactgaatgattccatttatgtgaagttcaagaaaaggcaaaaagtgatctgtggtggtagaaatgaaaacactgtttgcctcaggtggtcaggtganacattcattaactagaaaggagaacttcctggagtgaaagaagatacgttttgatggccaggcgcagtggctcatgcctgtaatcccaacactttgggaggctgaggagggcggatcacgaggtcaggagttcgagaccagcctggccagcatggtgaaaccccatctcnactaaaaatacaaaaaattngctggacatggtggcacacacctgtagtcccagctacttgggaggctgaggcaggagaatcncttgaacccaggaggtggaggttgcagtgagcctatatcacgccactgcactccagcctagatgacagagcaagactctgtctc

SEQ ID NO: 360098 - DNA, 3753 bp, Homo sapiens
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatatgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggcggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggttgtctacttgggggatgaactggtt

SEQ ID NO: 360099 - DNA, 2776 bp, Homo sapiens
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatatgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagactcaaaagctacaagttagctcaagcaatgtgacattatttcaaggatatgtgccagggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacct

SEQ ID NO: 360100 - DNA, 789 bp, Homo sapiens
  misc_feature (747)..(748): n is a, c, g, or t
  misc_feature (757)..(757): n is a, c, g, or t
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatatgtaaacatacagtgacaacattaaacttttctaagtnnaatgttgtngtcgacgcggccgcgaatttagtagtatgtag

SEQ ID NO: 360101 - DNA, 739 bp, Homo sapiens
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggttgtctacttgggggatgaactggtt

SEQ ID NO: 360102 - DNA, 485 bp, Homo sapiens
gtgcagtgagagcagcttcaggtcagtggagagcgacatactccatgcatgccttcacagaaggggaaactggtgcgggatggaatgggcgtttagactggaggttaacaagcaaaaagggtcattatttaagttaagaaggttgcgcccaattttctctggggcggtgtgaccggcagcccgtaccaagtcccccgactcggactcacgcgggcctgtgtgtcacgcatttgccgcttccttaccagctttttttccctagaaaagaagccagagaaactggaacggagggggcgagggaaaccaaaaagtctcacctaactttctgatttagaggctacgacctgccattcacgacctttaaccttgagaattaatgtctcctaacttaagattctacacctctaaaatgggggtcataaccacctacctggggattaaatgagataatgcacgtaaagcgttttgggcagtgcctgacacat

SEQ ID NO: 360103 - DNA, 3696 bp, Homo sapiens
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactggtacgttgatgatccttatcagaagtatcatgatcgaacaaacctgaaagtatagatcagaagtttcacttgtttctcagttattggatatgtatctttgtgtacatatctttgcaaaaatggataagtacaaaacttgatgtaaattgtaccaatgaatatgtaaacatacagtgacaacattaaacttagaaaagttttaaaacttaatggatcagactttgccagatttggttagggaaacagaaatttagaatggtgcattatttttaacaaatggtattggcttaactagttgtttcagttatgctcttttagttgcaaggaatctcaagtgggacaaacataaaaagaggaattcaggaaccacctcaccaaccccatctcccactcagaaatcacctcccagcctcaggaagagtagaaattgggtggtgctcctcagcaggggaaggtggatgtttaggcttgggctctgcatgcatgtgacttgcttctttttgcattgttaactccattctctctattcaccaacttctctacacagcttttgcatacttacagtttctgttcctttgtaataactttaacttgcacctttgaggttcttttctacatgatgaccttcagctcctgctgctagtctccaattgccaagggaatttaactgggccagactacctttttatactaggtctggttgggtcattgtctagagtagggattggctgtccttaagtcaggagcccgctttgtattagcaggtttgcatgcagcaaaaaaacagttatgtgagcagtttcacttggaggttcacatggggtggcagcacacttaacatctaacacaccaggttcattgtgttcataacacttgtcatttactgtaacaacattttttcataggagagtaaatagcccttcagcatgctcattcatgaaacagaagaggctgtacaagtgaagacaagggctttttatgcaagttttgaaagataggtatttattttttctagagacaggagttttgctctgttgcccaggctggagtgcagtggtgcaatcatagctcattgaagcctcgcactcctgggctcaagtggtcctcctgcctcagcttactgagtaaggatatgtatttcttaaaagttagtttatccacttcagatttcatgttttcatttgtaaggataaacttttcccacaaattttcaacaatcattgtagaaactaagggggagaaagtaatctcagttgttttagaaacgaaaaagttaagcattgtttacttgaagtgggcagggaagcagcactgagtaaagttcaattgagtggttacagtctagggcagtggttcccaactctccgatcagaatcatctgggaagcattttcaaacagcaaagtactttgaaaaccattattaaatagaattatgcatgaattactgtttcagatcctttaatgtggtagttggtaataataagatgaaattcctctgttgttagtaaaattatgaaattgaagttctgcagcatgtcaggccaggattattagggagattcctcgaaactagtgtgtgtttattaaaaggagaaaggataacaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggcggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggttgtctacttgggggatgaactggtt

SEQ ID NO: 360104 - DNA, 1941 bp, Homo sapiens
ttaaacccaaagcggccgccgtaggcgaaggtgaagatggctgcctctgcctttgctggtgcagtgagagcagcttcaggaatcctacggcccctgaatattttggcatcttcaacctaccgcaactgtgtcaagaatgcctctcttatttctgcattgtccactggacgttttagtcatattcagacaccagttgtttcctccactcccagacttaccacatctgagagaaacctgacatgtgggcatacctcagtgatccttaatagaatggcccccgtgcttccaagtgtcctgaagctgccagtcagatctctaacatacttcagtgcaagaaaaggcaagagaaagaccgtgaaagctgtcatcgataggtttcttcgacttcattgtggcctttgggtgaggagaaaggctggctataagaaaaaattatggaaaaagacacctgcaaggaagaagcgattgagggaatttgtattctgcaataaaacccagagtaaactcttagataaaatgacgacgtccttctggaagaggcgaaactgacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggactggcaaccagagcctcagcatccaaagatggactgaagtgggatggctgacaggcacataacttacgggaaagggaatttcatacatacgatttttgttttgtgggtaggagggcttatcatcaacactgattttataatctgacaataaatgtctttcattaaagagtttacctaaatgatgttcgattatatgtataatttataaaatatttatgtatagtttgtttattcaggtatatgtataatttattgaacacctactatgtcccagcatatctacaaaactgggtacatacatactgtctaactgctaatccacatttccagtcttacaaaggacataatgattagttaagccctaatttagatttgaggaaactgaagctgagagagggttaagtaaattacccaaagtacagctaataagacccagaatctcagtctcactccttgggatcctgtgtatttccctgagtcttctaacatatgaaaattcatatctaaatcaacaagtgactgtaatctggtactataaatactaaataaacacttcttcataacactgtaccaattcagcttttaaattttattactttgctttcctgtcctttgccaactcttaacctagttaatcctagttctgttgacattggaccaggctcagtaaataaacgaatggatttccagcctttttttcccatctgttcctgcttttagtcctctgaatctgcttcttttcttactgctgctttattttacagtgattttgtcaaacatagaatacaggactaaaaatgcaaagaaattgggtctgtgtttaattttgatgtttcaaattttgagcttccaagtctttgtggccacccaatgaagtttgagtctgcctgttcagatgtgaaaggtaagggctgcagcaggtttaagggcggcccttcaccaccctgttgtcacctgcacaggcactcccccatttgcagatgaagaaatgttcagagaagaaaaatgatggaccaaacgtctgtttgcacaattgaaactctaccagtggactattctattttcacagctacctagtttctgccgatgatttttttaaatgtgaaataaacagtgatactttcaggttgtctacttgggggatgaactggtt

SEQ ID NO: 360105 - DNA, 399 bp, Homo sapiens
aaattaatgtggaacaattataaaacatattgtataaatactctttgatagtgaaatagttaagagtgtttaggcttacaacaattgtttgaacttgctaagaaggcttaaagtttttatttttggtaactgagtgatattaatatcataatatcttcacacaaaagtactacttagaaataaaacctcagagtcatgtgagttctcaagttgccacaactcttatttgttgggtattttcctttccttttttgttttgaattccttggaacataaccccttacataaaagcatagaacgactccactggtaatcttattaattctttgtaaagagtaatgaagatttcctgattttcttacttcttgatctcattgtttctgtggctttgcaaagcta

SEQ ID NO: 360106 - DNA, 6702 bp, Homo sapiens
  misc_feature (1551)..(1551): n is a, c, g, or t
  misc_feature (2166)..(2166): n is a, c, g, or t
  misc_feature (2267)..(2267): n is a, c, g, or t
  misc_feature (2410)..(2410): n is a, c, g, or t
  misc_feature (4696)..(4696): n is a, c, g, or t
  misc_feature (6263)..(6263): n is a, c, g, or t
  misc_feature (6390)..(6390): n is a, c, g, or t
  misc_feature (6428)..(6428): n is a, c, g, or t
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaagttgcaggcttgaggtgggagctccctgaggaggcnctggtcccccacttagcatcagtgccctcagacccccaccaggcaggatgctcagccccaccctcacacctgctgttgaatgggccaccccgagtgtgggtttcctgggccaggcctcaggagatgataggccccaaccatagctgcgtcgatgtccacatgacccctcaccccgaggaggccaggagctcccaacacacaggttgaggccaggatcaggatcaggaagtaactgaactccctaaagagtgaagcagagaaaggtgcctgtgagggacggcaaggggggcttgcagcgcacagggccaggccagatgtgggatccgggagggcacgcctgcccgcagagggtgcagtggggaaggcgcacagggtgcacctccaggtgagtgctgggcagaaggcacgagagcagcaagggagtgtgacaagcaccgcctcacagtggccaaggccacagtcacagctgcggctgcacacagggtggcccccagggcacaacacagcaagagcaggacttagcagccagagcctcacactgcatgcagccgggcccagcctggccggtcgtctcctcctaaaagcgggtgttgattgggaaagaaccatgacccngaatattggagtggggcccatgggcagatccagagaagctgggaccacacacgcctgtgtctgcccggattgccggaagagcccctctagctgaaggcccngggtggcctcccttgaggcagttgccctgcaaggccctgccgatgctccttgggacccccacctgggcttctagtcctagaactagactcgagtccagcagacccccaggatgagatacagagggtgaccctgagagtggcancagcctcctgcaggaccacatggcatttccaggtttccaggcagaaatctgaacatgtgtgggacggatcggaagggtgtgggatccaggtggccggagcaggggtggatcaggggagttcccggaacagacctgccaaacggagggctggactgggcgctgcagcttggggccaggaaggctccagtgccgggctgggggtgggggctggattacagcctgagggtggctgcactgagtgaagtggacatggccagccgccgtggggtacagccgaggagggcttccaaggcctggggatgggggtgttggatttgtcagtgagacctgtgcacccactgcagggggtcccaaggccgtgcctccccaaccccactgtgaggaacatggttgctggggggcccggagtccttgaggagtcctgtgaccacacttctctgttggtcagaggtaccatggggaccgttccatcaaacgggaatgtcagtgctggccgggaaagcggcccctggcccaagcttggagaccacctggctcgggtactggcctggctccgttggacaagggtggccaccaggtgcccaggacctttggagaggggggccctgctgcttttcctcgagtgtcctatagccgccaggatgcgtagggcactccgggaggtattttcatatcactgaggtgtcagggaggggaagggtcctgggtttaggctgcagtgactgcaggtgctgagggagctgtgccctgggtgctcatcacaggctgtcacagtgagggaaggtgtcaggttctgacatccccatgacagcggcagggtaggtggagtgggaattggctttgcagtttccctgcatgcccttgacagccttgccaaaggcacatctgccccgcctcagctcccaccctgagggttctgggcctctaccccttcccctgtttatgtccctgtcatctttggcatcatcactgtagttacaaaactccctacgtcccacagccacgaggtgggtatcccacatgagggcccaggtgtgcatgccagcatgaggttggcgagtggcactgcctgctgatgtcttacatagaggccatgaagagctgtgggcagggtgtacagaccctgagttggcccctggccctcgtgctttcagtcaaaggcacaagcagggtggatggcaggcggctgccccctagcctggccttgagctccctgccccaggccatgtggcgttgagcagtgtccaggcacatcttgttctgaatctcagtgtgcagggatggagtcgggacagcgtgagtcctgcatgcctaacacagccctcacccctccagtgcacaacggggccacgtgcccgcatctgggtggctaggcagatagggccccccttgccaggcagatccagcttctgaggccttatagacgtcctgtggagggcaggcccaggactttcattcacctggctgagctgcctgggagagcagcagaaccggtgctggggtccaagccggccaagagcagtgcagccctcctggtcctgttcctctcttgagctgctccgtggtgtccacagcagagccatgtggctctggacaggtcggcctttgtgtcaacagaacctgggtcgtgatgaatcaccatgcgtctgaccagccttgaaacccccacaacagaagaagaaacggtctcagctccagacatccagcttggaaaagatgcacctgaacattggcattctcttcctagcaaacagccacttcctgtaggctggcaggaacgccaacagagccagcagtgaaggcattaagtggggaggaggggtggcccggaggcagcacgcgaaggtcagcatgcagctcctgggatgaacctgagaggcgactcctggcagcatggctggtcgctgccatcacgcccctggccaacccaccaactgggagaggcagcccttccacatcttcctccataatgctcttgggtagcagtgaggcctctcaagccagagagaacttggtgtttggaaacaacggcggacatttcttgccattttcagtgccaactcaggtaggtgtgttctaccatcctgtgtttttggggtgtttttttttttgagtcagagtctcactctgtcccccaggctggagtgcaatggagcagtctcggctcactgcaacctctgattcccaggttcaagcgattctcctgcctcagcctcccgagaagctcaggaccacccacataggtgcaggccatcatgcccagctaattttttatttttttttatngagaaggagtctcgctatgttgcccaggctggtttcgaactcctgggctcaagcgatcgatcctcccgcctctagcctcccaaagcactagaattataggcctgagccactgcgcccggcccaccatcctgttcttattggaagaatttccatgtgtcgaggcacgggcacaacgtagctggtcctctgctcagggccccacaaggctgcgtcagggtggcagcgcggctgggggctttttctgttcaaatccagattctcgtggctgtgagccccagccctgggcactgtccgcctggtggtgtcttcacagccagcaggggtggccttggggtgttctgtggagtaactttcacggcccagagtgggatcctgagtggctggagccgtatgctccagcatccccagccgctgcctccggtgcaggtggagtgggcccctctgattaccaggagctgtcagaggggcagcaggtcccactccactggccggtgggcagctgtgtgcagggacgcgggtcctggcacgtctgcctggtgaggccctgcctccagtgccaaggggcctcccctctcgacggtgggcgccaccatgtgctgacctctgtgcagccccactttacaaggtaggttcggccagcaccccatccgcgggcgggcagcactcacccagcgttgcgccgccaacagggtccctcttagacaagcagctgtgcctagagccttttccttcctccctgcgtgttacctgcaggccaacagacggccctgggtctgggaccaggagaacctgcctccgcctctggcagtgggtgtccctgcaggcagattgggcttggcacgtagacaccgaggggtcagccgatgccgggagatgatcccgggaagggctccggagcacagcccaggacccgccgccgctgctgggcgctccatgttgacgtgctgtgcgtgtctccactccccaggcaatgatgttcaatcaggtgtttcccacctgtgtctctgccaagaagccacagaacaccctctgcacaaaaggagtgtttgcacaaagaaaaacaaccctccgggggttctttagaaatgcttatactcaattagctagaacttcatgtgaaatcccagcgtggaagacaacaagccggcaccggtgaaaactttgctgtgcacctgccctctaccaagctgccagccccaccagccctgtggtcctaggtgggcacagctgctgcacggtcccccaggcctgcctctcctcggggtctcaaccttcataccagatttgccagcatccccattcccgccttgtgggtggagagtccttgagaccctctgtcactctgtcagcttccccaggtcagcgagctgtggcttggctcccacgcatcagcttttatgggaggcccattaggagctgggcaggagggacagaggggaggccaggcagccactgctgagtgggacgggtagcccagcccatgaggctggccagccctacaggggaggtcccacagcactggccgggaagtccacataggaaagcatcagttgagggatgaagccanggacgatggggacaacggccacagggtgtgctaagctgaggaaattagtaggaggtgctcataagctgttttgttttttggtttgtttgttttttcttttaagagaccagggacagtgggggtctcnctctgtcacccaggctggagtgcagtggcatgatcatngcttactgcagcctccaactaataggctcaggtgatcctcctgcctcagcctcccgagtaactcatggcctttaagtgaactgcttccaccatccagctgtgcaggtggcctgggaacagcagcacatctgtcccctgccacctcttgcatgcacacttgacctcctgacttgggctctgaaacctgtaaaatgtggggtgtagagaaatcgagtcatttggcctcatcctggtgccattatctcttgctacattaataaaccacctcaaacag

SEQ ID NO: 360107 - DNA, 2582 bp, Homo sapiens
  misc_feature (28)..(28): n is a, c, g, or t
ctgccgtgtgtctgagggccagtcatgnagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaagccactgaaa

SEQ ID NO: 360108 - DNA, 1515 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 360109 - DNA, 704 bp, Homo sapiens
  misc_feature (28)..(28): n is a, c, g, or t
ctgccgtgtgtctgagggccagtcatgnagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagaatcgcttgaacctgggaggcggaggttgcagtgagct

SEQ ID NO: 360110 - DNA, 1421 bp, Homo sapiens
ggccgatctcgttctccactttctaggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 360111 - DNA, 1813 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagcctggactggcagcaggccctgcaggtgcgtgggactcatgaactcaccaatcccgggatcgccgaggtcacgatccggccagatcgcaagatcctggccaccgcaggctgggaccaccgcatccgcgtgttccactggcggacgatgcagccactggccgtgctggccttccacagcgccgctgtccagtgcgtggccttcaccgccgatggcttgctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaaaaaaaaaaaaaaaaaaaaagaaaaagagaaaaaaaaaaaaaaaaaaaaaaaacaaaaaacaaaaaaaaaaaaaaaaaagacaaaaaaaaaggagagggggggcgcggggcgacgacaagaagcaaccttcccacccgcggggggggacgcgccccgatgaactagccgcgcaccccccgcgaggttctgtagacaaggcagggggggcccccaaaataggagggcggccatatatataaaagcgcagaggcgcagcgggcgccgcgcgttaacaaccacacagggtgggagagacact

SEQ ID NO: 360112 - DNA, 1471 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaagccactgaaa

SEQ ID NO: 360113 - DNA, 1079 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 360114 - DNA, 2622 bp, Homo sapiens
  misc_feature (28)..(28): n is a, c, g, or t
ctgccgtgtgtctgagggccagtcatgnagcatccacctaggcaggcttgagagtccttgggagagtccaggtgacctggtttttaattaaaacgcgtcctgtttattgtggttgggctctgcccagaaaggaaggtagggccttgaagtggtgatgtccaggtttcctgcacaggtagggtggaggcaacgatggactctggcatggccttccagacaggcagtgcacacagctcctttcagagtggctttgttgccagctgctgcagcacctgctttcagacagatgatgaccaagctgctttcctgctgggggaaggaggcattccccctgggttgtttttctcttctggcccccacacactggcagacccgaaggcagggtgctcaggagctgcagagcctggcagggtttgctggacatgctcagggacgggccatggtgctggctctgctttctaatcatggtgtcagtccttcacttcccttggaaatacccagagattttatttcctgaagataggacatgatgggtgctgtgagatggtatttaaagtacctgtctgcaaggaaaactttaaaataggaagtactaaggataaggtcctatgggatattggaatattttataaagccacaatagttaaagcacttagatgtggacagatgagcagagaatagaggactttgaaacgggccaaataaatatggaaatttagtacaggctagaggtgtttccaattaacgagtaaaatggattattcagtaaaagcagttggccctctggaaaatagtaaagccatgtatgtgcctcactctttatgccagtacatattccagattaaagatttcaatgttacaattatgaaagtactagaggaaaatatgggtgaatttttttttttttttttttgcctatgattccaggattttaaaagttttagatgcccagagttgtggaggtatggagaagtggaccttctcatactgttggtgggaatacacaataatataatttgaccacgtaacaattctaggcacatgcatgctgtgactacttgctaggtgcatgaaggctcttgccaggggtggtcatggttcggtaccactacatgggggtttagagcagggactggaggttggccttgcctcctcccctccccgcatgagctgagggtccttacctgacctttttgagctgtgaccagagtttttcctcatggggtggttagaagggttgaatgagaatgatgcccatgcagtgccttggctggggtctgggccctctaacacccacctcatgggtgtcactgttttttgaacagcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcagagcccctctgccgaccgcgatgcacatgtaatatgagcaagaaataaatttttgatgtgcgaagccactgaaa

SEQ ID NO: 360115 - DNA, 1298 bp, Homo sapiens
catgcgccgggtcgtacacggcggccgcgcgcacgctgggggcgtggctgcgcgatgtaatcggtctctggacgctgcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcaggtaactgcatcctgcccagcatgacggccccctgcccgccgccacctccagacccccagtttgtcctccgaggcacccagtcaccggtgcatgcgctgcacttctgcgaaggagcccaggctcaggggcgcccgctcctcttctcagggtctcagagtggcctggtacacatctggagcctgcagacgcggagagcggttaccaccctggatggccacggcggccagtgtgtgacctggctgcagacgctgccccaggggcgccagctcctcagtcagggccgggacctgaagctgtgcctgtgggacctcgcggagggcaggagcgctgtcgtggactccgtgtgcttggagagtgtgggcttctgccggagcagcatcctggccgggggccagccacgctggacgcttgccgtgccagggaggggcagcgacgaggttcagattctggagatgccctccaagacgtcagtgtgcgccctgaagccgaaggcagatgccaagctgggcatgcccatgtgcctgcggctgtggcaggccgactgcagctcccgcccactccttctggccggctatgaggatggatcggtggtcctgtgggacgtctctgagcagaaggtgtgcagccgcatcgcctgccatgaggagcccgtcatggaccttgactttgactcccagaaggccaggggcatctcaggctccgcggggaaggcgctggctgtctggagctggccgcgggctccaaggatcagcggatcagcctctggtcactctacccacgcgcatgactcacccactcccttcccgggagacgaggagggcgggcagggaggtgggcatcaggccccagccttggcctgaaacctcaagggcctctgaggaccagcaagtcatggcccaaggaccatggagtccccgctgtcttcatgaggttggtatttccttttgtggagtgcctcatcacaggacggtgactctgggggccagccagagccctggccgtccgaggcctgcaggagacgttggcttgggcctgctgtgttgccagctgagggtattttataataaatttccattgccaa

SEQ ID NO: 360116 - DNA, 948 bp, Homo sapiens
tgggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtaagatacaaactcttttggtagggaattaattttgaattgaaaagaatttttaaaaatccaaatctaagacatggcatgtttaggaagattttagaaacactaaaataatgtgatcctttggattgcctcaatgttcttactcaagtcatctcacttataaggagagttataggctattcagtatcaagatagatttctttggtttatttggttggttcccttttcttcatattggttgtaatctcctagatactattacgctatcttgtttgggaatgatgtttcataggtttgtgatgatctttacgttcaggactcagttttaacacccagcccagtggttctttcatagatgggaacctgtttctacaa

SEQ ID NO: 360117 - DNA, 836 bp, Homo sapiens
tgggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcaggtaaggaaaaggattcccaaatctgtgttaacagattggaaggagactaagctgtttggtgaatgctagataaaaagggtatcaggtaataaaagactacactatcttagtgaataatgtgtcactttaaagtgggagtagaagagctgttgaatgtgagtagcataggcacaggaggagaaaaggcatatctttggttatacgtaggaggggattccaatgtggctggcactggatcctgacagacagctgattctgctctgtagtgggcgagagtatatggtgaaacatggattggagttcatttataatccaaaggattagtttagacttctctattagaatctgttagaatttctttctttgggcttccctgaaa

SEQ ID NO: 360118 - DNA, 1217 bp, Homo sapiens
tgggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtgtggttcctcagagtgcaccaccagtgccaacagcctcttcccggttccatttcccacctctggacacccattctccaaccaatgatgtgcagccgggacggttctctgctagctccctaactgcttctggccaggagtccagtaatggtactgatagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtccccatttcaccagccctctccctgactcccaccatcttctcctatagcccatcaccaggcctgagccctttcaccagcagcagctgcttctccttcaaccctgaggaaatgaaacactaccttcattctcaagcttgttctgtgttcaactaccatctgagtcctcggacttttccccgttacccagggctcatggttccaccactgcagtgccaaatgcatcctgaggagtcaactcagttctccatcaagctgcagccc

SEQ ID NO: 360119 - DNA, 895 bp, Homo sapiens
tgggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtaagatacaaactcttttggtagggaattaattttgaattgaaaagaatttttaaaaatccaaatctaagacatggcatgtttaggaagattttagaaacactttataaggagagttataggctattcagtatcaagatagatttctttggtttatttggttggttcccttttcttcatattggttgtaatctcctagatactattacgctatcttgtttgggaatgatgtttcataggtttgtgatgatctttacgttcaggactcagttttaacacccagcccagtggttctttcatagatgggaacctgtttctacaa

SEQ ID NO: 360120 - DNA, 471 bp, Homo sapiens
ttgccagttcgtctggagcagttctcatctgggggctcttttgctactaaagggacatctggtaaggcctgcagacatgtttggttgtaactgagagctgctgccagcttgcagtgggtggaggccaggggtgctgctaagtaccctacaacgcacaggacggccccccacaaacggttatcttgaccaacatgtgactagtgctgggctgacaagccctgctccagagacccagccctgtgtttcagcattgttcccttctcctccactttttcctttctatgtattatcgagggacagcctggtgttggtaacattcggcttctgttgggaggaggaaagaagcggaaactcaggttatcaaacacagatgtgccagggcaacaggacccaacagctactacacagaattctgaacatgggcccagaacaagatgcatgagaagtccaggcaggaacggtgggaaacca

SEQ ID NO: 360121 - DNA, 761 bp, Homo sapiens
gcggccgcctactactactaaattcgcggccgctgatctcactcccacagtgctctgctaacaatgcttggtttagatccaggtagtctatagacagaactcagacctgccccaggtcataagcttctccacatagaaagctgccatggctttcaaaaagccatgcccctcttcgtcttcccaggcatggccaggcacccagctcctatgctcctgtctgcagcacacttcccacttgccgcaactcctccctccccattctgttcaagggaatttgttccactcgagattatattacaaaattcagttgggaggttctttcaccctgtgtcctttccctgagctcattggctgacttccagagggtccctgtgagatatattcaggaatagcttccctgggttcatgctggagattgggaagtcctgctgcggctcctacttttttatttccctaaatctgttccagctattggaagggtgaagggcttctccagtggcctggattttcagattccctggtggggatgtgtacttggaggcagactcttcccctctcgcactctgaggacttaggagtttttcacctgtctcacgtagtaggctatagcctcccaattctttcacagggtctgtggattctgttttcctaagttcctgtgttggttctttgggaaaaaattcacactgaatctctgcacattattctgtccttccaagtgggagaagcatgctgacactgcctccagtctgccatcttga

SEQ ID NO: 360122 - DNA, 1083 bp, Homo sapiens
ctttctggcccagcgagagcgcccagggggtgggcgtcttgccccgggcgtcgagagtttggggccgtcccgtacgcggcgcgccgcaacccagtccccgcgaccacagcagcctgctccccaccgcgcttgcagagcccggacgcgcgtgagtcgggggcccgcagaggcctcacccttggaggtcgccgcttgtcaggcctgactgctgttggcgcccaccccgccgcccccgaggggccgctcgaggccggactgctgctttgccgtggcaggccccacccgggacgtggcgctgcgggccggggcggtccagctgcaatccctactccctgccaaaggagaacccagttactgaacatcggatgagaccatggatagtaaattgggagtgaaggtccatacctgggtctcagaagcacagtacaggtttttagaacaagccaccttatacaagttaaaattcatgaaggaatggatacaggttaagttacaccagcctcctgagtatgacagcaacattccttcagggattaaagaaaatgcttcagaagattggaacactgctcagccttcccaaccttcttttaccactgatgtttctaccttagtgatcttcctccttattttaatgcttctttctctttacaattaaaagttcataaaatctttcaacattatttttcactacaaaagtctgaagttctctgtgaaatgcctacatgtaagaattaagatagattttaaagactgtcagtctcaaaattccatgctcatcagttagtgcatgatattaaattatgcttttttcctccttttaaatataccaacattatattgctgatttttttatttacctgggtaagagcactgactcggttctcactaggaaacaaaggtgggtcttctccaacttgaaaatcaaaatatacagttttatgtgtgaaagtagaaaattcattgctgaagcaaaatttgtatgtcccatttttggaggctgtgaaggtaaaactatcatactgtttcttcatctctttgtataacactttaccatcaggatcttctaatcgacaatctacatca

SEQ ID NO: 360123 - DNA, 825 bp, Homo sapiens
ctttctggcccagcgagagcgcccagggggtgggcgtcttgccccgggcgtcgagagtttggggccgtcccgtacgcggcgcgccgcaacccagtccccgcgaccacagcagcctgctccccaccgcgcttgcagagcccggacgcgcgtgagtcgggggcccgcagaggcctcacccttggaggtcgccgcttgtcaggcctgactgctgttggcgcccaccccgccgcccccgaggggccgctcgaggccggactgctgctttgccgtggcaggccccacccgggacgtggcgctgcgggccggggcggtccagctgcaatccctactccctgccaaaggagaacccagttactgaacatcggatgagaccatggatagtaaattgggagtgaaggtccatacctgggtctcagaagcacagtacaggtttttagaacaagccaccttatacaagttaaaattcatgaaggaatggatacaggttaagttacaccagcctcctgagtatgacagcaacattccttcagggattaaagaaaatgcttcagaagattggaacactgctcagccttcccaaccttcttttaccactgatgtttctaccttagtgatcttcctccttattttaatgcttctttctctttacaattaaaagttcataaaatctttcaacattatttttcactacaaaagtctgaagttctctgtgaaatgcctacatgtaagaattaagatagattttaaagactgtcagtctcaaaattccatgctcatcagttagtgcatgatattaaattatgcttttttcctccttttaaatat

SEQ ID NO: 360124 - DNA, 1022 bp, Homo sapiens
ctttctggcccagcgagagcgcccagggggtgggcgtcttgccccgggcgtcgagagtttggggccgtcccgtacgcggcgcgccgcaacccagtccccgcgaccacagcagcctgctccccaccgcgcttgcagagcccggacgcgcgtgagtcgggggcccgcagaggcctcacccttggaggtcgccgcttgtcaggcctgactgctgttggcgcccaccccgccgcccccgaggggccgctcgaggccggactgctgctttgccgtggcaggccccacccgggacgtggcgctgcgggccggggcggtccagctgcaatccctactccctgccaaaggagaacccagttactgaacatcggatgagaccatggatagtaaattgggagtgaaggtccatacctgggtctcagaagcacagtacagttacaccagcctcctgagtatgacagcaacattccttcagggattaaagaaaatgcttcagaagattggaacactgctcagccttcccaaccttcttttaccactgatgtttctaccttagtgatcttcctccttattttaatgcttctttctctttacaattaaaagttcataaaatctttcaacattatttttcactacaaaagtctgaagttctctgtgaaatgcctacatgtaagaattaagatagattttaaagactgtcagtctcaaaattccatgctcatcagttagtgcatgatattaaattatgcttttttcctccttttaaatataccaacattatattgctgatttttttatttacctgggtaagagcactgactcggttctcactaggaaacaaaggtgggtcttctccaacttgaaaatcaaaatatacagttttatgtgtgaaagtagaaaattcattgctgaagcaaaatttgtatgtcccatttttggaggctgtgaaggtaaaactatcatactgtttcttcatctctttgtataacactttaccatcaggatcttctaatcgacaatctacatca

SEQ ID NO: 360125 - DNA, 371 bp, Homo sapiens
actcaatacccttcagaagcctgagaggcgagtgtgaggctgcttagtgcccctaaaataggtacgactgtacagaaaggaagagcgtttaagaaaacagtgaacaggctctgcctgccaagtctgtgcttgagctgcagtttctcatgtgcacgggtgttgagaataaagaaagcatgtctaaaaacccaagtctaggcaggaatttctatagcctctggttattttaccgagttactataatagatgcatgtccatgcataagtgtgaatatacacaaacatgacattataaaaggagatagctttgccatgttacacacccaattcacaaaatggcatcagttccttaagccttatttgctattgtaa

SEQ ID NO: 360126 - DNA, 505 bp, Homo sapiens
tgaactctgtttgtgaaatgaaagagactatgcatctgcgcgtaaccatcacaatcgtgtttctgttttggccttaccagtgaaacatgtttcgcagaacagccaggtttttggagtgagatgaaaacgaactggaaacagttcctgatctatctaactgtcacctaattacaagcatttagcattctttatgaagtgtgcaatgaggcagatactttctgggaaaacaaaaatggggtctatcttattaggtcaggtttttgagacagacacatgagataaaggcttggtacagaaacgctggctataaaaagcaaaattagggcaccttggcatccagttggagtgaatagtttcagtgatgtaataagatactctggcacattctgtctgctagaaagggtgtatagaaattcaggtgtgcccctgctgatgtgatttttctgtcaggaccttgcaaaatggaaagatcgtcgaaaaagttacacttcagatctgcagaaga

SEQ ID NO: 360127 - DNA, 1125 bp, Homo sapiens
gtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360128 - DNA, 1101 bp, Homo sapiens
acagtcgttctgtaatttgtaatcatagaaacagaatgttcctcctcttatttcttccctgccaacagtttctgggtgggtgaatgtcagtagctggagttatttttaaagaggagaggtgaggcttgccgtgcaaagctggaaagagggcgtttgtttgcagagcagagctgacatcaaagtgtagattactgctcagtggctaggcacttgtcctgtaacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360129 - DNA, 1020 bp, Homo sapiens
gacttttgaagggtggggtctgtaggaagaatccatgcattgctctgggaagtggcctcaggaagtagagggctggggacagaatcactcatgagttgcagttgttctgggcaacaaagcaaggcggatacttattctggtagcagggtggagtttgaactgggcagttacctctgctcaagccccttgaagaatttcagattccctgttaaccatggaggcatgggctggaagctgggtgtgggggcaggcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360130 - DNA, 738 bp, Homo sapiens
  misc_feature (418)..(418): n is a, c, g, or t
  misc_feature (662)..(662): n is a, c, g, or t
gtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgataatataaacgttttcttgaaagcttgtgaacagattggattgaaagaagcccagcttttccatcctggagatctacaggatttatcaaatcgagtcactgtcaagctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggatngtaactgtgaactgtgcccggctcctgaaagccgacaccatgcaacaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggcagtacacgcttttggcccgaccaatgaggccttcgagaagatccctagtgagantttgaaccgtatcctgggcgaccagaagccctgagagactgttgatacagcaatcttgaagtcagctatgtgtgtg

SEQ ID NO: 360131 - DNA, 766 bp, Homo sapiens
gcagccctggatcctgacttagagaatgatgatttctttgtcagaaagactggggctttccatgcaaatccatatgttctccgagcttttgaagactttagaaagttctctgagcaagatgattctgtagagcgagatataattttacagtgtagagaaggtgaacttgtacttccggatttggaaaaagatgatatgattgttcgccgaatcccagcacagaagaaagaagtgccgctgtctggggccccagatagataccacccagtcccttttcccgaaccctggactcttcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagactcaggcacaagaaaaggctgatggtggagagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360132 - DNA, 1417 bp, Homo sapiens
aaacggctacgtcggggctggtgccgcgcgctgccgctgggcacccgcttcgcttcccgcgtcctgcctgactgcccgggtccccgcgggccttgggtcgctttcaggagtttagagaaagccaggtcttcacgttcgtgtaggttcgagaccttaacgaactgcagagcgcaacaaagggaactagagccccggcgccttcgcagccggagcggaagccggagttgtgggaggcccgcgtgccctccccgcccgtggggcccagacgcgcggggacaacccctcccctccacgcatcccgagtctctctctccctcccttgtcctagccatggaagggctggaggaggcagaggccaactgctccgtggcgttcgctgaggctcagagatgggtggaggcagtaacagagaagaattttgaaacaaaagattttcgagcctctctagaaaatggtgttctgctgtgtgatttgattaataagcttaaacctggcgtcattaagaagatcaatagactgtctacaccaatagcaggattggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaaggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360133 - DNA, 1155 bp, Homo sapiens
gtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcactttccacttcttttcacaggataatataaacgttttcttgaaagcttgtgaacagattggattgaaagaagcccagcttttccatcctggagatctacaggatttatcaaatcgagtcactgtcaagcaagaagagactgacaggagagtgaaaaatgttttgataacattgtactggctgggaagaaaagcacaaagcaacccgtactataatggtccccatcttaatttgaaagcgtttgagaatcttttaggacaagcactgacgaaggcactcgaagactccagcttcctgaaaagaagtggcagggacagtggctacggtgacatctggtgtcctgaacgtggagaatttcttgctcctccaaggcaccataagagagaagattcctttgaaagcttggactctttgggctcgaggtcattgacaagctgctcctctgatatcacgttgagaggggggcgtgaaggttttgaaagtgacacagattcggaatttacattcaagatgcaggattataataaagatgatatgtcgtatcgaaggatttcggctgttgagccaaagactgcgttacccttcaatcgttttttacccaacaaaagtagacagccatcctatgtaccagcacctctgagaaagaaaaagccagacaaacatgaggataacagaagaagttgggcaagcccggtttatacagaagcagatggaacattttcaagactctttcaaaagatttatggtgagaatgggagtaagtccatgagtgatgtcagcgcagaagatgttcaaaacttgcgtcagctgcgttacgaggagatgcagaaaataaaatcacaattaaaagaacaagatcagaaatggcaggatgaccttgcaaaatggaaagatcgtcgaaaaagttacacttcagatctgcagaaga

SEQ ID NO: 360134 - DNA, 721 bp, Homo sapiens
tcctccagaaattcaagcaaaatttctctgtgtacttgaaaggacatgcccatccaaagaaaaaagtaatagctgtagaatattagttccttcatatcggcagaagaaagatgacatgctgacacgtaagattcagtcctggaaactgggaactaccgtgcctcccatcagtttcacccctggcccctgcagtgaggctgacttgaagagatgggaggccatccgggaggccagcagactcaggcacaagaaaaggctgatggtggagaggtcagagtgtgtttctgcaaggattttgcttgtaatggatggtcttgtgtaacttttctcatgcgagaaagcagctcatcgtgttgctcaactctgcatgtcgcgtgccattttgaagcatcccgtaaaatttaatttgctttgaaaaaccctcagtcgttttgtacaaaaagtgcaattccatatttgcatatctctaaataacttatttaggcctgtttaagactgtatatacataaaccttgcctttgacttaagcagtactgtggtactatccaccaatatgaagtttctggacttctcatgttcaggcatttttgtaacagtctggttatagtttggttttatgtgttgctcacattttagagtgtctgatttttttgggggggtgaaattttcccttaaaatatggcattgcaaatttcatttaacttaatttttggttttggcc

SEQ ID NO: 360135 - DNA, 453 bp, Homo sapiens
ctaacttgcagtctaacagtgaagaagattttttttctccttctgagttctctcccaccactgtctagttcttttggttgcctccatatgggctccatatagtacccagtccaagactgggtcttacataggtgatttctgatctagtggggctattctaaagctagtcactgagccagcaggcagcttggcccagttcctggctgcaaagctctgcctttaacctctaggctctctagatacatagttttaatataacttgtggcctcaggtggagagtgtagctttttcagcctccctgaggtaaggaacccctacctggactactgctttagacagcaagcttgtcctttgttcctttcctcagttggatgcttttagtccttattattctgcagaaactcctggccacctttactacttttggttttttttttttttaagccgagtctc

SEQ ID NO: 360136 - DNA, 4725 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360137 - DNA, 2033 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagaatgtcatggaagcagaatcgtacagtatgttcccttctgcatatgctgctttctcactcagcatcatttccttgagatgcatccaggctgctgcacgcatcaatagttcattcctggctgggcgcggtggctcacgcctgtaatcccagcgctttgggaggccgatgtgggtggatcacaaggtcaggagtttgagactagcctggccaagatggtgaaaccccatctctgcaaaaaatacaaaaattagccgggcaccatggcatgtgcctgtaatccctgctactcaggaggctgaggaaggagaatcacttgaacccgggcagcggaggttgcagtgagccgagatcacaccactgcactccagcctgggcaatagagtgagactccgtttc

SEQ ID NO: 360138 - DNA, 1750 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagacttgaatctgtagacatttctttattgatatggcaaattgcttgcagatatttttaaatgacagcaattttctaatatttggtttaataaaatgtgaataatgtccctttta

SEQ ID NO: 360139 - DNA, 523 bp, Homo sapiens
tgctgaaccctgccatcttagacacggctcctcccttttccatgcctctgtttctgcatctgtaaagtggagaccataatgcagtcgcctctcctgggctgctgtgaggattaaatgagctcttgggcgagattatgcgaatctccagttgtgtggtatttttagcacgtcttatttgtctgcttgcataagctccgggcgctcatttctcaacaattccttacaggcataaactgccagctctcagacccttccagcaccaagccaggtaccttgttgaaaaccagcccctcaccagagcgatcgctattgctgaaatgtaagacccccgggagtggggatagggtggagacggtggagatggtgggatgttgggtggaggaggatcatggaaatggaggtccctctttttttctcattagaatttatttatttatttatttattttaagaacttgttttttaaaaaatgtttattattaaaggcaataaaacaatacatgttcattgtagaaaaattagaa

SEQ ID NO: 360140 - DNA, 573 bp, Homo sapiens
agctcaatgattttttaaaaaggaaacatattttgtaaccaccttcagatcaagaaatggaaatttccactccccagaagtcttcctcatgtgccttcttgtttactatccccaaaggggatccactctccagacttctaggactataggttagttttacctgtttttgaactttcagtagatcattcacactatacccttctgtgttttgcttctttcactcaatatgagatttatccatttttgtatattgacatactgagtggctgttataaattcacttagtacttctaagctatctacagattatttgggtttttgtgtaaataagcatgtcacctatgaataataatctttcatttccccgatctttattctttcctttcacttctttttcgtgccttgagttactgtctactacatttagaacattgttgaatagaagtggttataatgagcagcattttctcccaccttagacatatatccaacagaaatgcatacatatgtgaatcaaaagacctgcacaagaatgttatgtgaccgaaacacaggttcagttgctcaacgctt

SEQ ID NO: 360141 - DNA, 4849 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtcccttttaaccatggtcttcactgggagttcatgttgcttcaagtccctagcacccagtgatacccccacaggtaagccctcagcatcctgaatacatcatccgcagcctgggaaccttctccctcgtacag

SEQ ID NO: 360142 - DNA, 4259 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360143 - DNA, 3317 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttacattgtctcatatcaaaagtgccatttttaactcaaaaactattgaaaattgtcagttttatatggttcaaactaatgcactgaaagtctatttaaaccacgaggattcggcgaccttggcctcccaccaagcaccttttaagat

SEQ ID NO: 360144 - DNA, 1817 bp, Homo sapiens
  misc_feature (22)..(22): n is a, c, g, or t
tgcgggtgtctagaggatccgngttccttgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360145 - DNA, 2018 bp, Homo sapiens
  misc_feature (141)..(141): n is a, c, g, or t
  misc_feature (162)..(162): n is a, c, g, or t
ttgtcctcaccggagaagagcatatcaggaatgagctacattgtcctcttcagcatctggcatcctttttagctgacctcagctccacattgacctctattctgcgacgcctcatttctgtactgtcttttcccttgttcntgaatctgtgaagacgggcanctggtgtagtagcattctcgttggtggacatggttatgagacaaagggaaacaccggtgtttccctttgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360146 - DNA, 2231 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggagtgctttcagcattttctgcctacaagatcctttgaccagtcctttctctgatgtggagtgactgctatacaatgccaactaaacacagaggccaagggcaggaaagggataaagacaatggagaagtaaagggctgtaaggaagtgagaatgaaggcttaaaggaaaggacatgtgcagccagctctcacccctctctgcagccacccagcaactggaggatatggactttgtttggaaccaccccttcttctggtgctctgtttataatgcactgttggccagtgcactaagctggccaacttgaaggagagattgcatcactggatctttttctgtctccagtgggctgacacaggggcctagcccagaaacatctgctgtctaaggagcaggtggaggtggatgacagccaggtccctggagaccgccattcctgccctcgctcactcaaacacaacctgacagcatcagcaagggaactgagaattcagagaatggccttaactgcaaagacctgaaattcggcaaaataacaccaatactccagaagtgtcacccctcaagggcaagccttttcccacgacataag

SEQ ID NO: 360147 - DNA, 1874 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccagacttgaatctgtagacatttctttattgatatggcaaattgcttgcagatatttttaaatgacagcaattttctaatatttggtttaataaaatgtgaataatgtcccttttaaccatggtcttcactgggagttcatgttgcttcaagtccctagcacccagtgatacccccacaggtaagccctcagcatcctgaatacatcatccgcagcctgggaaccttctccctcgtacag

SEQ ID NO: 360148 - DNA, 953 bp, Homo sapiens
ttctcacttacgtgtaaacaaaccctgactcccacctgttcccatccaagatcgtattatagcttgaactcctggtctcaagcaatcctcccacctcagcctcctaagtagttgggattacaggctcacacaagcacgcctggctcacataccaccttctaacatattgtgtgactgaatcactatgctatggatttttatgcatctgcccccatctgaatggaagttctctgaggaagggattggggcttgttcatggccatatactctgtgcctaaagcagtgcctggcacaaagatggccctcaatatttgttcagagaaggaacacatgccatttccctctctttgctctgaaaggagtgctttcagcattttctgcctacaagatcctttgaccagtcctttctctgatgtggagtgactgctatacaatgccaactaaacacagaggccaagggcaggaaagggataaagacaatggagaagtaaagggctgtaaggaagtgagaatgaaggcttaaaggaaaggacatgtgcagccagctctcacccctctctgcagccacccagcaactggaggatatggactttgtttggaaccaccccttcttctggtgctctgtttataatgcactgttggccagtgcactaagctggccaacttgaaggagagattgcatcactggatctttttctgtctccagtgggctgacacaggggcctagcccagaaacatctgctgtctaaggagcaggtggaggtggatgacagccaggtccctggagaccgccattcctgccctcgctcactcaaacacaacctgacagcatcagcaagggaactgagaattcagagaatggccttaactgcaaagacctgaaattcggcaaaataacaccaatactccagaagtgtcacccctcaagggcaagccttttcccacgacataag

SEQ ID NO: 360149 - DNA, 243 bp, Homo sapiens
gcacatcttccctgagtcgccgcccatccttgagtgttggatccagtagttgttcgcgcctcagctcctcctcctatttaggactctcccacaccagccttgtcatcctggggttttcctgtccctgtgaattcacataaatcccttaaatctgcctggctcttgggcgagattatgcgaatctccagttgtgtggtatttttagcacgtcttatttgtctgcttgcataagctccgggcgct

SEQ ID NO: 360150 - DNA, 3974 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaactttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360151 - DNA, 835 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcaggtggggacgatggggacggggttcgccgcgcgggagttgggggagccagcccaggcataacggccgaggagggggcgtgcctggccgtggccagtggcgggttacaacctggaaaccaaaggtgccccagagggcgtctaagcggtcgaccgaaagttcagagcgggagcctgagacccaaggaagggcaaaggcgagccaaagccatcagttgagcttcagaaaaggtgggtttaggagtgagaggttgggagcccaggctggtacccagatgtccttgaccgtgtccaccatggccgatccgccacactgccattgggctggaagacagtctgccttttagttaac

SEQ ID NO: 360152 - DNA, 4374 bp, Homo sapiens
tcaagattagaggcatacctgatgtggacctccgaggatcagagatgtcctagtcccagctcatccaccaacttgccatatgactttgggcaagttacctcaccttcagatgcctccattggaaaagaatacaaggaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360153 - DNA, 4441 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360154 - DNA, 4826 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatatcaagaaatggaaatttccactccccagaagtcttcctcatgtgccttcttgtttactatccccaaaggggatccactctccagacttctaggactatagacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttta

SEQ ID NO: 360155 - DNA, 4383 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtcccttttaaccatggtcttcactgggagttcatgttgcttcaagtccctagcacccagtgatacccccacaggtaagccctcagcatcctgaatacatcatccgcagcctgggaaccttctccctcgtacag

SEQ ID NO: 360156 - DNA, 3213 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagggtttgatgactcatcaaaccctgtcatcaacccttcatcaaacccttcatcaaacccttagaccactacaggccaattaacgcggttatttgggggccttcttatattgctttccgcagggttagggtttcgatga

SEQ ID NO: 360157 - DNA, 2059 bp, Homo sapiens
ggcgttactggaacagcgtcattaagcaggaagcccaccctctcctagctggctcattaggagcttcccatttctggtgggaccacctcccggcctgggcgggcagagggagcaccctgctggtcggaggatgctccgaggcccgacgctgctcccggcgggctgtcatcctcctaggggtcggccggccggcctggagccgccccgcccacggccgaggtttcggtttcccttgggagccccgccctgtgtcccggggagccggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggccagagtgacatgcattactgaagagaagcctgaagaagctgacacgggtgggagcacattcactgatcatttcatcagcctggctcagggagggctggtcctgaccatccctctcaggccagcctatcctttttccacacacggcagcagaaccgagtagagtccggcaggacacaccttctcattgcaggccatctcacagggcagcagctgcttggttggggagcccagggcacgctccacaagacgcactgaccgcaccagctcggccagttctccaggctccagcgaggccgagtggtcactccccttccaggtcttgtccaaagttatgtgacgttccaacaccttggcccccagagccactgcggccacagatatcgctatgcctgtttcatgcccagaataccctatgggaat

SEQ ID NO: 360158 - DNA, 658 bp, Homo sapiens
gagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaat

SEQ ID NO: 360159 - DNA, 966 bp, Homo sapiens
cctgtgccccccgtgaaaaatctcatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaag

SEQ ID NO: 360160 - DNA, 853 bp, Homo sapiens
cctgtgccccccgtgaaaaatctcatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaaggaaaaaaaaaag

SEQ ID NO: 360161 - DNA, 432 bp, Homo sapiens
ggtacctgctggtcaaggccaagtgttgtgagccaaggtttctaaccttggctgcagttacacttaactgctcctctccgaagctggatttagcagagatttgatggaagccctgcaaacctcgattcaaatcaaagttcaaacctagtgactggttgagtgaactgctttaataataacagtgcaaaaattgaatttaaaataatccttttagggatgcaagatgcagtggtttagccttttattaatattcttttctttccactaataaagattttaagtcaacatctccttaaatttgattaattccattaggatcactccaaaaaaaggtttatcagtggctttgaaatccaaatgggatgaagaaaaaatcatttatatggcaaaatctcagttacactaactagattaaagaccttctgctgaatt

SEQ ID NO: 360162 - DNA, 757 bp, Homo sapiens
  misc_feature (691)..(691): n is a, c, g, or t
  misc_feature (693)..(693): n is a, c, g, or t
ccgggctgcaggaattctcgagatcatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatctcgagaattctcgagntnttttttttttttttttttttttttttttttttttttttttttttttttttttaaggtagatctc

SEQ ID NO: 360163 - DNA, 578 bp, Homo sapiens
  misc_feature (560)..(560): n is a, c, g, or t
gattgggtgggtcattatgtgttgtcgtgcaggtagaggcttactagaagtgtgaaaacgtaggcttggatcaaggcgacagcgatttctaggatagtcagtagaattagaattgtgaagatgataagtgtagagggaaggttaatggttgatattgctagggtggcgcttccaattaggtgcatgagtaggtggcctgcagtaatgttagcaaactcatcactagacatcgtactacacgacacgtactacgttgtagctcacttccactgtgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcaactcgaaagccccaagcgagcaaagaagattttctgaatatctgcattgaacctgacaccatcagcaaaggagactttataactataggaactcactttgtagtcccaagcggcaactcgaaagcgncaagcgggggatcctctg

SEQ ID NO: 360164 - DNA, 4476 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360165 - DNA, 4425 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttatcttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360166 - DNA, 4479 bp, Homo sapiens
gcgtggtactggcccggaatctttgggatcagccgtacaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360167 - DNA, 4396 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaaggtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360168 - DNA, 3794 bp, Homo sapiens
gtgaaaaggacagcgagtttcagagatgctggcgtcaagtacagagtattggctctaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360169 - DNA, 3085 bp, Homo sapiens
gcgtggtactggcccggaatctttgggatcagccgtacaaatctctagaagatgacggtgttctttaaaacgcttcgaaatcactggaagaaaactacagctgggctctgcctgctgacctggggaggccattggctctatggaaaacactgcctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360170 - DNA, 1275 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacatgaggaagctggtccagaggaaggcaagggagggctgcctgccaaggaattcggctttgcatgaagtt

SEQ ID NO: 360171 - DNA, 1080 bp, Homo sapiens
gcgtggtactggcccggaatctttgggatcagccgtacaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcagcactatcaggatgaatcacgctgggagccaactctgagtagaactccaggaagttaaccatctggtgaagagcagttctgacgcccacccctatagactgtttgtttctggattggtcccaagaacacagaactggactggtagaagctctgggaatttgtttgtgtctgcagttgtctttgtagatttgtctaacccctgaatcatccctgatctgaataacccccaaggatatcagttcagagcaagtgttacctctaaaagtcaaatcttcttaaaattgttgattcatatttttaaagctcatctccaagttcaactgatccatatcatgtacactgttatattccatgagattttacttaaatattcatttatatggctaattatagctggattataatatttgtcctttcaaatataagacagcatttttgcccccccactgcaaaaatgtgcattataccttgcagatgaaattctgagactgagttgcctttttgttttatatcatttgagcttatgatgtcagaaataccaaaatagaaacatgaaaatcaaaagtggcaaatgtgtgaagcatttagtaataaaaataggtggcagacctcatgtttgtttctgaaatgttttaacggatgacagtgagaatagatactataaattaattcctctctttagcgattgttacaatagatactataaattaattcctctctttagcagttgttacagtatatactataattcctctttttagcgattgttatctagctgttctaaacctgtgttttacgaatttgattacttctttgtttaaatgtattatctttcatatggctctaagttgttttggaaatcaattcaaataaactttaatattaaacc

SEQ ID NO: 360172 - DNA, 4422 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360173 - DNA, 4490 bp, Homo sapiens
caggcggggagcgcagtgcgggtcgctgggactgagcgcgcgagcgggcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360174 - DNA, 3806 bp, Homo sapiens
tagaggatcccggtggttcttgagaagatgctgggtcaagttagaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360175 - DNA, 3398 bp, Homo sapiens
  misc_feature (2)..(2): n is a, c, g, or t
anttgaaaaaaaagaaggctgtaccgtccggtattcccgggctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcacaagccccacccagtgagcagcagaagacaagcactctgagaccacactttaggccaccggtgggaccaaaagggaacaggtgcctcagccatcccaacagtgtcgtcagagggtccccagggcattttcatggcaagtacccctctgcccccactccagcagtgcttcccaaagtgtgctctgtcacctgctttgcaatcggcttccattagcgcatgttttattttggtgtgacggttggccctcctaaacacggactttcctcaggctggttcaagacggaaaaggactttcttctgttttcttccaaagtgcaaccacagtggagagcccacggtgggcttagcctgcctaggcccttccatttctcttctttgaccgtgctaggaattccaggaaagtgcattcctgccctggtgaccttttcctatgtctaggctcctccacaggtgctgctattttgtgagctccggctcctgtttagcttttatttcagttctaacctcagtccagaaacatatgtgaggttgtttccctcttcagccacggctacaataccggaaaatgctagtttttatttatttttttaagtagtgcttcctaaatggtttgcatgagagccacctggggtacatgttgaaaacttatttggggtctaccccaaacctaataacccaaatttggggatggggcccaggaatatgcatttttaaaaagtcatctgcccttcccaggtgattctgtaagttgtccctcaactgtacttggagaaatcgtgttttaaagcagtagtccacaaagtattctgctcatgtgcccccaaaagtattttgaaaaatcatgtataccctcacccatctaagttgatatctaaaattttatctaagttggtatctaaaatttttcatgggaagttaaatagttgacaaagtatgtatttgctggtgtcgtgtaaatattggtattttaaaataaaaactgttacatcactattttaaacatatccagtacaatttaaatatcacaacaatttgacacccttcattcatttataaaaataaatgagctagttctttagtagttaaacatttcttggcttttctccttctgtatttccataccacttttcagccaagaatcctatcataatgtaatctattatgcccgacatcttttaatcattcaccccattacttcttgtcaacaaaaaatataaatggaaattttttttttagctcttgctttaagtgtttgtttgttatctcagtccagaaccaatattatcgtaattaattattggtatataatgaaaacggtattaattcttggatgattaaaagtttttttattagaatgttctttatcctaattagttcatttatccaagaatacatgaatgtgatttacagctgagatggggttcaacctcagctgtattccttgtttctgtatagatgtaagcacataaattcgatggaatagaattacgttaacaatgtttttacagttctttggattcctttggcattttgacaaagatcacagtgctctatcatcaagaattattaatgatgatctatcaactaacaaacaacttgattagattctcctttagtctgttgaaagcagagaactgaaatccacctgatttaccatggctttgccagccagtcattagcaccatttacttttactatcgctgacattttcctttgttcagtggccctgaggttcttacactctagggggcagtgcaccacaggaagatagatcaatgagggaggattgcgagggggaaggggaggaagcagagctggcaggccttagctacaggctctctctcaggcagatcccttttaagatacatacaccatgcccacacatcccatggagagagaccaatgctttagtagattacagaacagctatgaaaagtccatgaatgaagatcacaaaaaggaaggctttcttatttcatactgtattcttcagggtggtaaaatttctgcttttggcaaaaacataacagacggttccaaacatcagcataaagatcactcatcccataccacccacaggtagggaggaaggatgctgtagtatatgaaaacaaaagttttcacctgagctgagagcatttagcatatcgtggttctgtaacaatatcaaggaccagtgcagaatctggctttcttttctgataggctaccagtgtgtgtttatgtgtgctcattttgtggttctaatcataatggtacatataattagggaaggatatggaagccactttagaatcttattcatttttaaatataaatatgccttgtttcaaactttgttttcttgattcaggctttctttcctgtgagggcttggtttccttattgttgactgctttgttctttgccttgtccttccctataaagcctgcatggaagacgtttaatagtgcaactaaaagagagtcagctgagtgaggcttgtcagccaaagctggaatgctgagctatctggaggagatcctaataacccaatttggggatggggcccaggaatctgcattgggaagtcggccacccttcccaggtgattgtttagtacaaactttttgacagattaatttcactcaaatgcaaagattaatcccagcactttgggaggccaaggaaggtggatcacctgaggtcaggagctcgagaccagcctggccaacgtggtgaaatcccatctctactaaaaatacaaaaattagctgggcatggtggcatgtgcctgtagtcccagctactctggaggctgaggcaggagaatcgcttgaacccgggaggcagaggttgcagtgagccgggatcgcaccactctgcactccagcctgggtgacagagcaagactccgtctcaaaaaaaaaaaaaaaaaaccgtagttgctttctattaagatagggttttaaataaagcttttttcctttccctcacagctgttttgcacatatctggatgcagttatatttcctaagtgccagtgcttcacatatgtaactgatgcatcagttctcacaacaaccctaggaagtagctacaggttgagcatccctaatctgaaaaggcgaaatctgaaatgctccaaaatccgaaagtttttgagtgccaccatgatccttaaaggaagtgcccag

SEQ ID NO: 360176 - DNA, 1353 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccaacatattactgatgccacacttgccattgtgaaaggagagacagttccacttgatgtcttgcagatcaagggtgaaaaggaacagcctgtatttgcaatgaccggccttcgatggggatctttcagagatgctggcgtcaaagttagcaagtactggtatcttgggcctctaaaaatcaaagcagcccactttttcagcactcttaaggagtggcctcagactcatcaagcctctatctcatacacgggacctacagagagacctcccaatgaaccagaggagacccctgtacaaaggccttctttgtacaggagaatattacgaaggcttgcgtcctactgggcacaaccacaggatgccctttcccaagaggtgagcccggaggtctggaaagatgtgcagctgtccaccattgaactgtccatcacaacacggaataatcagcttgacccgacaagcaaagaagattttctgaatatctgcattgaacctgacaccatcagcaaaggagactttataactataggaagtcgaaaggtgagaaaccccaagctgcacgtggagggcacggagtgtctccaagccagccagtgcactttgcttatcccggagggagcagggggctcttttagcattgacagtgaggagtatgaagcgatgcctgtggaggtgaaactgctccccaggaagctgcagttcttctgtgatcctaggaagagagaacagatgctcatctagcaacatcatcctccgtgcccactactgcctgtgccccaccctgtctgc

SEQ ID NO: 360177 - DNA, 1037 bp, Homo sapiens
gggaaaggcagagccgcgagctggaccagccgtgcaaatctctagaagatgacggtgttctttaaaacgcttcgaaatcactggaagaaaactacagctgggctctgcctgctgacctggggaggccattggctctatggaaaacactgtgataacctcctaaggagagcagcctgtcaagaagctcaggtgtttggcaatcaactcattcctcccaatgcacaagtgaagaaggccactgtttttctcaatcctgcagcttgcaaaggaaaagccaggactctatttgaaaaaaatgctgccccgattttacatttatctggcatggatgtgactattgttaagacagattatgagggacaagccaagaaactcctggaactgatggaaaacacggatgtgatcattgttgcaggaggagatgggacactgcaggaggttgttactggtgttcttcgacgaacagatgaggctaccttcagtaagattcccattggatttatcccactgggagagaccagtagtttgagtcataccctctttgccgaaagtggaaacaaagtccagtaggttgtcaatgtggggaattagcatttgtgggtgagcgagactgggaatgaaacaatttcatgtgtatgctataactttcttgagttttgatagcctgaaacttcaaataattaagaggagcacctagatcagagttcagcctttcagttcctcgcggaagtctcccaacttggtgtgggactcttataattaagtctccccaggtccagtaagggcaggtgaaatacttgatgtcctttgtcaggtatgcagattatatcctgacctaaacgtttgtgccttgtacaattggtagcgatctttcactgacagacatatttgggctgaccactacggaggcctaagtattagccaggacacaataacaagtccccggtgaagactgacctagtcgcctggctacactacctgcactacaactactaaaacagtacattgcccaaccttgggaaaacacaactggcaac

SEQ ID NO: 360178 - DNA, 4664 bp, Homo sapiens
  misc_feature (30)..(30): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttaca

SEQ ID NO: 360179 - DNA, 4372 bp, Homo sapiens
gcccaagctgcctcggttcaagtctcagcccagtcacttcccagatgtgcgactcaggaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttaca

SEQ ID NO: 360180 - DNA, 5816 bp, Homo sapiens
  misc_feature (30)..(30): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacaaaaaaaaaaaaaaaaaaaaaaaaaaaaaaaaaaaaaaaaaaaaaaaaaaaaaaaaaaaaaaaaaaaaaaaaaaaaaaaaaggaggagccggacgacaaaaaagtgtaccatgatagaggagcaaatatataacgagagcaccacatattatagagacaagggcggctcgctccacgaggagcgacaattatattaaaagacaggaacgatcagtacgcgccgagctctctatctataatacgagtttacgaatatcagggctgagcgacaacaccgtagcaacctgcgaggacactctgtatataagaaaagaccccattttactctaaagcggaggcagcacaatacactagtggcagacaacactcatccttcagcaatatttataaccatcagtgaggacaatacaacaacacctcaaccgggagaacaccgggggcaacccaccaaacaaggcatacatcacacgcccccacaaacaacagcagggccccacccgcgagcagacccccaagaacaacaatactaccagagagacacaaaaaaaaaaagcacaacaaaaccacaacacaacaccccacacctggacagaaaggaagagaacgaggaaataggagagaggacgaagagagtcggtggacgcgaggggcagcgagtgatgaagacgacaatagagaggaaaagaaggaaccagcaacctcagcagtagaggaaagaaaaagagaaaagctgacacagcagacacaagccgcggccaataagaatgacacagaacaagagaagcacgcaaacaagacaaaaagaaccagaccgacgacaagcgaacgcggacgaaacaaccaaaagaaaagaaaagacgaaaaaaccaaacaagccaaaggacagaagcgcagagaacaacaaaagacaagaacaacagaaaaaaaaaaagagagagagaaaaaaataacggatgaaaaacaacaaagcaataaaagacacaaacaaaagaagcgagaacaaaacataacgaaagcaaagcaacacaccaacacacgtgaaagcacacaccagcggaacacacacaggaacaagagcaaatagagaaacaaaaagaagaagaaaccgaaacagagaacagaaccaacgacgacaccgaaaacagacaaacgc

SEQ ID NO: 360181 - DNA, 4073 bp, Homo sapiens
ttgataatatttctgcccagaagctgtttttgatccataacttacttaattggctcttcccctgtggtgttgcttctaggccccggctgaaaaacgtggacaggagcactgcacaactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttaca

SEQ ID NO: 360182 - DNA, 4886 bp, Homo sapiens
  misc_feature (30)..(30): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacaaaaaaaaaaaaaaaaaaaaaaaaaaaaaaaaaaaaaaaaaaaaaaaaaaaaaaaaaaaaaaaaaaaaaaaaaaaaaaaaaggaggagccggacgacaaaaaagtgtaccatgatagaggagcaaatatataacgagagcaccacatattatagagacaagggcggctcgctccacgaggagcgacaattatattaaaagacaggaacgatcagtacgcgccgagctctctatctataatacgagtttacgaatatcagggctgagcgacaacaccgtagcaacctgcgaggacactctgtatataagaaaagaccccattttactctaaagcggaggcagcacaatacactagtggcagacaacactcatccttcagcaatatttataaccatcagtgaggacaatacaacaacacctcaaccgggagaacaccgggggcaacccaccaaacaaggcatacatcacacgcccccacaaacaacagcagggccccacccgcgagcagacccccaagaacaacaatactaccagagagacacaaaaaaaaaaagcacaacaaaaccacaacacaacaccccacacctggacagaaaggaagagaacgaggaaataggagagaggacgaagagagtcggtggacgcgaggggcagcgagtgatgaagacgacaatagagaggaaaagaaggaaccagcaacctcagcagtagaggaaagaaaaagagaaaagctgacacagcagacacaagccgcggccaataagaatgacacagaacaagagaagcacgcaaacaagacaaaaagaaccagaccgacgacaagcgaacgcggacgaaacaaccaaaagaaaagaaaagacgaaaaaaccaaacaagccaaaggacagaagcgcagagaacaacaaaagacaagaacaacagaaaaaaaaaaagagagagagaaaaaaataacggatgaaaaacaacaaagcaataaaagacacaaacaaaagaagcgagaacaaaacataacgaaagcaaagcaacacaccaacacacgtgaaagcacacaccagcggaacacacacaggaacaagagcaaatagagaaacaaaaagaagaagaaaccgaaacagagaacagaaccaacgacgacaccgaaaacagacaaacgc

SEQ ID NO: 360183 - DNA, 3453 bp, Homo sapiens
gtcatgtagccggtccggagggctccgacggggagcgaactccgaatcctcgtatgcacctgctccatacacacagaaccaggctccaaacagcagcacctgcatacggcactgcgtgccgccatcaggtctgaaataactgcaggtacatccatgtaacggtatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttaca

SEQ ID NO: 360184 - DNA, 4545 bp, Homo sapiens
  misc_feature (30)..(30): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgtta

SEQ ID NO: 360185 - DNA, 4807 bp, Homo sapiens
  misc_feature (30)..(30): n is a, c, g, or t
  misc_feature (4678)..(4679): n is a, c, g, or t
  misc_feature (4681)..(4681): n is a, c, g, or t
  misc_feature (4689)..(4689): n is a, c, g, or t
  misc_feature (4692)..(4692): n is a, c, g, or t
  misc_feature (4694)..(4694): n is a, c, g, or t
  misc_feature (4699)..(4700): n is a, c, g, or t
  misc_feature (4704)..(4704): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacaccacaaacaacccnncnccacacanacnancccanncccnacaccaccccccacaccacaaacaacaaaacaacacagcagacagcacggaacacaacagggaactcagaaaacccaccaaagcacggcggcaggcggcacag

SEQ ID NO: 360186 - DNA, 4610 bp, Homo sapiens
  misc_feature (30)..(30): n is a, c, g, or t
gcggggactagtctcgtccggagactggcngcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttaca

SEQ ID NO: 360187 - DNA, 400 bp, Homo sapiens
  misc_feature (294)..(294): n is a, c, g, or t
  misc_feature (349)..(349): n is a, c, g, or t
  misc_feature (372)..(372): n is a, c, g, or t
acagattgggagaaatcaccacttgggggaactgggagtatgctgggctgtgtctgagctgcaaatattaaaggccacagacagaagcagccggcacttcccatctttgtaatccttactggaaagggccttgtggccctagggtgccccttccatctcgcattttctcagggtttccaggggcctctgagcagcttctgaagctccaaagctccgacttgacaccccctgggaaattgctttaatgctttcagcctgagggaaacttcaaattcagcccagttcagtccaatnctggaacttactcttggaagagccagagtaggaagtcttcacaagtcttcaaaanctgggggttggtctttaaaattnttgaggtaactttttatgttttgaggtt

SEQ ID NO: 360188 - DNA, 778 bp, Homo sapiens
aatgaacacaaatgaaaggaaggctgataaccatcattttactcgttacttccattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatt

SEQ ID NO: 360189 - DNA, 1574 bp, Homo sapiens
cgggacaacgcccgcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgggatatgtgcattactccatcaatgaaaccaaacattcgaagattgtctgaaacttacctggaacaactttttgaattggatgatcagctgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatatgctattgcggatacaacagatcatctattgtcacaagctaaccattatcctaacaaaatggcggaatacagcaagacataagagtaacaaagaaagaagatgagctgatattaaaacatgaacttcaattgaacaacttggaacactaggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatt

SEQ ID NO: 360190 - DNA, 1483 bp, Homo sapiens
cgggacaacgcccgcacgcgcccggcccctagtcccagcgcggggagggtactatcgcagcttctccgtcaggccttgggccatggcctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacatttagtaaagactcatttttgcacttggagagacatagctcgtacaaatgaaaatgtcgtcctggctgaaaaaatgaacagagcagtgacatgctacaatttcagacttcaaaaatctgtatttcatcactggcactcttatatggaagaccagaaagaaaaacttaaaaatatgctattgcggatacaacagatcatctattgtcacaagctaaccattatcctaacaaaatggcggaatacagcaagacataagagtaacaaagaaagaagatgagctgatattaaaacatgaacttcaattgaacaacttggaacactaggttaatactcaaaagagctgctgcagaagaatccaattttcctgaacgaagttcttctgaagtctttcttgtagatgagactctaaaatgtgacatttcactgttacctgaaagagcaatattacagattttcttctacctcagtttaaaagatgtgataatatgtggtcaagttaatcatgcctggatgttgatgacacaactaaactcactgtggaatgctattgatttttcctcagtgaaaaatgtgattccagataaatatatagtgtctactttgcaaaggtggcgtttaaatgtgctgcgtttgaattttcgtggttgtcttctccgacccaaaactttcagatctgtcagccactgtaggaacttgcaagagttgaatgtctctgactgcccaacattcacagatgaatcaatgagacacatttctgagggctgcccgggggtcctgtgtctcaatctgtctaacacaactatcaccaacaggacgatgcgactcctgccgaggcacttccacaacttacagaatcttagtttggcttattgcagacggttcacagacaaaggcttacagtacctgaacttggggaatggatgccacaagctcatctatctggacctctctggctgcacccagatttcagtccaaggcttcaggtacattgcaaacagctgcactggaattatgcatcttaccattaatgacatgccaactctgacggacaactgtgtaaaagctttagttgaaaaatgctctcgtattacatcgctggttttcactggtgcaccgcatatctccgattgtactttcagagctctttctgcttgtaaactcagaaagatccgatt

SEQ ID NO: 360191 - DNA, 1583 bp, Homo sapiens
cagggcccgggcagacacgccccctcaccgccgctccgccgccgattaggtttgaggaagcttcgcactccgctttcgaggccagcggaggcggggggcggggatggacacgccccctccctgtctcccaccgatgattggcgcacggaactccgccttgggtttggaaggctcgcctgggagctcatacctggctggggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaaaaaaaaaaaa

SEQ ID NO: 360192 - DNA, 1411 bp, Homo sapiens
  misc_feature (20)..(20): n is a, c, g, or t
  misc_feature (22)..(22): n is a, c, g, or t
  misc_feature (25)..(25): n is a, c, g, or t
  misc_feature (28)..(28): n is a, c, g, or t
aacttgttgactagtcgagncnggntgntagaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaaaaaaaaaaaa

SEQ ID NO: 360193 - DNA, 1363 bp, Homo sapiens
cagggcccgggcagacacgccccctcaccgccgctccgccgccgattaggtttgaggaagcttcgcactccgctttcgaggccagcggaggcggggggcggggatggacacgccccctccctgtctcccaccgatgattggcgcacggaactccgccttgggtttggaaggctcgcctgggagctcatacctggctggggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgagcatccacaatgggtaccccagcctcggtggtcagtgagccacccccttggcaggccccgattgaggcccggggccgcaagcaggcctcggccaacatcttccaggacgccgagctgctgcagatccaagccctgtttcaacgcagcggggaccagctggccgaggaacgggcacagatcatctgggaatgtgcaggggaccaccgtgtggctgaggccctcaagaggctgcgcaggaagaggcccccaaggcagaaacccctgggccactcgctacaccactgcagccgcctcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaacgagctgcggaaggactgtggcaggaacagtcactgtctctcctcattttggtgaggaatgggtcccacataatggaggctcaacagaag

SEQ ID NO: 360194 - DNA, 1273 bp, Homo sapiens
ttaagcctaattaaaatcttggctgggggattacagagaatatagcctaggaatgtactgtcgaggcattatgggttaaaaattgttgaaaacttttaccttgagatctctccccagtctccctggtgggccacttctttgcctaggccactgccagcccaggaagagtgaacccaaagggatggagctgaaccacttggcctcaaccaatcactatgggtgatgctctgggcttcatctctctgctgccttctctggggcccacaatcagaacatcagacctaaacaggcctttggaggtcatcaggtcctgagatggcaagtcagtgtcatagcttgtatttaactccagttaattagtagtcactgcttatcaaaccagtttaatagcatgacttatgacatctgccatgagtacaggatgaggatgaagaaatgttgagttttgcacaacctgatctggtccaaccctttctactgcagagaaatctgtaaactttgtctagtcagacagttctcagagggggaaagaccagagcagagccccgctctcattttgctccaaatcatatgttttatggtccaccatgacgaaatctcttgaagtccccattccattcttcctattgatgttggctaatcatacacttgttctctgcagaatcctggagccccactctgcactggccaacccacagagtgccacagagacagcctccagtgagcagtatctgcactctaggaagaaaagtgccaggatccgccggaactggaggaagtcaggccccacaagctacctccaccagatcagacactgatccagggaaagagccaggaatggcagtgtcttccctcttgccaaaaggcctggggaggtgaaggaagagagactttaggcaagcagcccaaaggggtaaatgaaagcaagaggctgctgccactgacctgctccattcagaacaagactggatgcttctgttgagctctccattatgtgggacccattcctcaccaaaatgaggagagacagtgactgttcctgccacagtccttcccagtctaacactattcctgggctgcatgatattcccctgggagcaaagtgacaggcacttagatgcagcatttcaccactcatgctactaatcatctacctgctactactgtaaaccatggttccagcagcctgttccacacccccacaccatcaggatagcacagggaaactgtagtttaagtggcaaataaaaacatttgcatcaaaaaaaaaaaa

SEQ ID NO: 360195 - DNA, 1018 bp, Homo sapiens
cagggcccgggcagacacgccccctcaccgccgctccgccgccgattaggtttgaggaagcttcgcactccgctttcgaggccagcggaggcggggggcggggatggacacgccccctccctgtctcccaccgatgattggcgcacggaactccgccttgggtttggaaggctcgcctgggagctcatacctggctggggccgaggattggctgttccggggctagggagcgctttctcccgggaaccgcggctgtgacccaagtggcccggaccagtttggggctgcgtgcggcctgcctcaagcaaccaggtacgtaggtcggcggcccagctcggcgctgcggtgggagccggagggcgacagtcagagccggggtgccagcgggacgcgaccgccagatccacttaggaccccgtcgttctgcgaagcggccacgtctgagtcccggggcctcctcgtgctgcagatgtcgccttaggacctcggccaggataccctctgccatgctcttgtgctgcccgtgatcaccgactggcccttgtaagcaccttcgcagcaggaagcccagagctgcgcctgccctttctgaaggctgtggaagaggttggagtgggcgcatcttagcttgccccatccccatttgaggtctgtcggagctgcccttcagtgtgccaggtggaagcccgggacaagtggactcttggtggctggactggaaggggaccggcggggaccagcctggaccagctgaccagagggctgcacatctctgctctgcagccgggcaagcagaggacatgcagccatagtcctcactccctttctttggttgtttttcaaaccttcaagatagttactttctgaggttgactgaccaatcgcaaggtgccagaattgtgaaatgtccagtagcacagggcatgaacacagctgcccctccagacacagatggcaccctttttactccctcctgaggccgtactttgctttggtgtagaaatggctcaaacacctg

SEQ ID NO: 360196 - DNA, 394 bp, Homo sapiens
tacagagtgggcttccaggagagaggtgcccaatgtcatagaagtttgacagggcaaaattacttgcagttaaaacggtcacagagtacctcaagagctggcacctgagcagtccaaattgtaggaagtgtgtgttaatgaccatttacattcctacctgcaggaatcggcaaagctgtcagggaagaagtgggtgattagcacatgtgcactgtggtcttgttccatctggttaggcctgaggaccaagggatgttttctgtatccagcacctggcctaacattgctaaaaaactgtcactatagcccttcaatctgagcacccttcagaaacccaaaacttttattgttatagcagtcctcaaaatatcattcgaatcacatagaactgtat

SEQ ID NO: 360197 - DNA, 358 bp, Homo sapiens
tttttcttgtacttaatttcaacctgataagttattataaatatttggagtagcagtggtgaagaaaatccggtgctaattttgttcatgccctgtgagctacaaaatatcagttaaggcccatgtagggccttaaattttgggtgtacttaaatttatttgtgcatttaaataagtgtactaaaattatgtagaaagactgtccatttgacttaacttttttcacaacttgtgatggcaaattaaatgtatagtgaccacatactgacaaacaatgaacttttaggtgtatgttgggatttgtaagtgagatttggattatatttagattatgttaatcccccccccatgagacata

SEQ ID NO: 360198 - DNA, 254 bp, Homo sapiens
attaaaataataaaattgtttaatatttatgaaaggcctttatattccaaagtgctcaaatttaaccacgactttaaattactatatcagacatggtatttttcttactggtttttgaaaaggacttgtaagttatgaatgcactattttaggctttgttcagcaggcagtgaaatctctttagttcataatgcatggttcagtgttctttaatattttgcaataaatcttagcagccagtgagaacttaaaga

SEQ ID NO: 360199 - DNA, 4424 bp, Homo sapiens
agcggagtgcggagccttaggcggagcgaagagaaccggtcgcggcaatcctagcgcgcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360200 - DNA, 577 bp, Homo sapiens
aattttatcagcatacagacttcctcacaatattgagacatagaaaatgggaaggcttctaaacaattttcagttgccccaactgtatgagtttcacaaaattccattctcttctgccaagtgatattattccattccttccctcgtgtatcttatctttattattgaattttccctcacaatccactgttaaaagaagaaagtatcacacacgtgggttcttttggctatggaagtgtccttgagatcactttttgcacgtgactcagctgaagtgttcaaagcacatggaaatcacttgccagtgacaggtggacgttgtatgtgttttctctctcctaaggatgcctaaactttcttttcttcacaggtaaagtcagtgataaatcttttgtttgctgcatatactggagatgtgtctgcacttcgaaggtatgtttacaggatggattagcatgcactttacagatatttatgaagttgcttctgggcgagcagccattttaaggttaaagtctcacttttctttccctttgataaaaatgaccccaacaagaataaagtttattaaattaaa

SEQ ID NO: 360201 - DNA, 448 bp, Homo sapiens
ttggaagtttgatttatagaacctcatcccttctgcttttaaggcaatccagtgtacaaggttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360202 - DNA, 410 bp, Homo sapiens
tcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtcatgcagtttttgaataagatggctggtaatgaatatgttggattcagtaatgcaacgtttcagtctgaaagagaaagtggaaggaaaagagtgctgagaaatggctctgtataatctatggctatccgaattctctgaaaaaataataaaagtcccctctattatatgagcctgtacagaaaaa

SEQ ID NO: 360203 - DNA, 4848 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360204 - DNA, 4823 bp, Homo sapiens
agcggagtgcggagccttaggcggagcgaagagaaccggtcgcggcaatcctagcgcgcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360205 - DNA, 4638 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgaaaaaaaaaaaaaaaaaaaaaacaaaaacaaaacaatactttgactaaaacagggaaagcgaactactatactcaatttggggcagtaacttgaacaacagttgcacgtttaccctagggattaactctcggggggggccccgtgc

SEQ ID NO: 360206 - DNA, 4632 bp, Homo sapiens
  misc_feature (4511)..(4511): n is a, c, g, or t
  misc_feature (4517)..(4517): n is a, c, g, or t
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgaaaaaaaaaaaaaaaaaanaaaaanaaaaaaaaatctatctttggtgcgcaataaaatatataaattaatatataaccttgtaatcaataatccctaccactcatcttatcccccttgaaaacaaaattccaatttgtgg

SEQ ID NO: 360207 - DNA, 4553 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggcttggacctttcttcactcaagtgcactaataaattatgtatgttgcttgaacaactagcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360208 - DNA, 4436 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggacgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360209 - DNA, 4785 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360210 - DNA, 3213 bp, Homo sapiens
ttggaagtttgatttatagaacctcatcccttctgcttttaaggcaatccagtgtacaaggttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360211 - DNA, 4471 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaaggctgtgttagttcacgcacagtttttctcatgaggcttattatctgggcgtcgtttttcctc

SEQ ID NO: 360212 - DNA, 2813 bp, Homo sapiens
acctgcatttaaaatctaggaatgtggggtgatcatctttgtacataaattacctaatgatcctgtccatgctgtgctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360213 - DNA, 1508 bp, Homo sapiens
ctataacttatcacaaaagaaatattagcatttataaaatttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360214 - DNA, 3261 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgttttggggggcacttatgggttcccccacacccttttacagttttttccaggttttaagggtctctggggcaagggttaaaattctgggccctatccccctct

SEQ ID NO: 360215 - DNA, 990 bp, Homo sapiens
catgccttagagcctcgggcgctaatctgtaggtttaacatggatatatctagatatccttaatgattatcacatgtgtggtatgaaggatgttgtctctcgagaagtgtacttcatcactagctataacatatagcagactgtggctttgaatgttgcagtattgcatctcctacactagtgatagcttcttcaagtgccttactgcatcatatcgtagtatggcatactcaaatcgtacctccggcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360216 - DNA, 1975 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggggtaagcaaaattcttatttagataagtatataaaatttttaagaagagaaaaag

SEQ ID NO: 360217 - DNA, 2030 bp, Homo sapiens
  misc_feature (1307)..(1308): n is a, c, g, or t
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttgaagaacttggtacatattagtcataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctnnattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaa

SEQ ID NO: 360218 - DNA, 1705 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccaggtaatctaattatgtaaatcgtatatataaatggatgtgtcggctgggcacggtggctcacgcctgtaatcccagcactttgggaggccagggcaggtggatcatgaggtcaagagatagaggtcatcctggccaacatggtgaaaccccatctctactaaaaatacaaaaattattcgggtgtggt

SEQ ID NO: 360219 - DNA, 402 bp, Homo sapiens
ctgaggaagagaggtgaagtggcatctacccaaaacacctgtgtactggttaataaggtcggtagttcccattaatgagcttgatgaaggatggcacctgacagggccttaaatgaactgatggagtgaatgttaccagtgtgaattaaatttgctttatatataataaatagctgtgcttacacattttcagatttgctttgtcagctatggacatggaacagcgggactatgattctagaacagcactccatgtagctgctgcagagggtaatacaggaactactcctatctattttctttccagatttaatttctacttagtactaaaatctgctctttttttgggggtgggacggtataggtcatgttgaagttgttaaatttttgctggaagcctgc

SEQ ID NO: 360220 - DNA, 4493 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360221 - DNA, 5111 bp, Homo sapiens
  misc_feature (4461)..(4461): n is a, c, g, or t
  misc_feature (4467)..(4467): n is a, c, g, or t
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattaaaaaaaaaaaaaaaaanaaaaanaaaaaaaaaaaaaaaaaaaaaaaaaaaaaaaaaaaaaaaaaaaaaaaaaaaaaaagggggggggggaaaaattctcccgggggggggcaatgggaccccccatttttttgttgatcgcaaagcggggggccccaaatcggaggggtcctattcaaatcagcaccacaggaccaggcgccgcccgattaaaacacacagagcagtaggataggaaaaaacaacggcccacggagtggaattcattgtgaaggaagcaaacaccaaccatcggcacgggggggaacaaaacgacggagcaacacaccaccacacgacagaaagtttacagagactgcggagacatacaacacaacgagcgtgactcttcggtcaacacacaagcatactgatgccgagcgcaaaaaacattcggcacagaggacattaacatgaaaacatttccgacgggtggtcgtgatatcaagccgaaaaaaacaacggaacaaacacaaacgacaccaaagaacaagacacacagccaaccagcaccgcccacagagagcgaaaagaaaaaaacacaaatacgacgcggaacacaccgacaaagcccacaagacacaacagacaacacacgaagcaaacaaggacaaacagcgaccacaaca

SEQ ID NO: 360222 - DNA, 4434 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360223 - DNA, 3278 bp, Homo sapiens
gaatttggacagaaggagcctgttgcataaattcttaactactaagcttataggaaaactccaatatttaaaattttaaacaaagctatatagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaaggcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagtttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctga

SEQ ID NO: 360224 - DNA, 3730 bp, Homo sapiens
tcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgttggtcttcctgcaaaatctggagttgctgggggcattcttttagttgtccccaatgttatgggtatgatgtgctggtctcctcctctggataagatgggcaacagtgttaagggaattcacttttgtcacgatcttgtttctctgtgtaatttccataactatgataatttgagacactttgcaaaaaaacttgatcctcgaagagaaggtggtgatcaaagggtaaagtcagtgataaatcttttgtttgctgcatatactggagatgtgtctgcacttcgaagatttgctttgtcagctatggacatggaacagcgggactatgattctagaacagcactccatgtagctgctgcagagggtcatgttgaagttgttaaatttttgctggaagcctgcaaagtaaaccctttccccaaggacaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360225 - DNA, 1153 bp, Homo sapiens
tgcgtacctgggcgtatgcccttttcctaacactcactacaaaactaactaatactaacatctcagacgctcaggaaatagaaaccgtctgaactatcctgcccgccatcatcctagtcctcatcgccctcccatccctacgcatcctttacatacgcccaggtacgcaaacccgggacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaaat

SEQ ID NO: 360226 - DNA, 2385 bp, Homo sapiens
  misc_feature (1662)..(1663): n is a, c, g, or t
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagtaagtttttatatttttctatcttaacttaaaaaaatcaataataataaatatatacagtattattgaaatatagtcttaaaggtcgtctgacatgtagattctgactgacaatatttctcttattatgttttcaaatttttgtcatgctcatttcaaggtaatcagtgaaagaaaaagaaagaaacaatgagaaacttgtccagaaagtgggtaatagtgacactaagatgccatattcatgttcaagtgttgggtagaagtttttatatacaggaataaaatcttatagttggtataagcatatacattatttgcactatatatttacaaactcttatttttttaaaaacaggcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttgaagaacttggtacatattagtcataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctnnattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaa

SEQ ID NO: 360227 - DNA, 1857 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatgataaaccacataatcctatggtaaatgctggagcaattgttgtgacttcactaataaagcaaggagtaaataatgctgaaaaatttgactatgtcatgcagtttttgaataagatggctggtaatgaatatgttggattcagtaatgcaacgtttcagtctgaaagagaaagtggagatcgaaattttgcaataggatattacttaaaagaaaagaagtgttttccagaaggcacagacatggttggtatattagacttctacttccagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgtaagtaattgtttaatcttattttctctggcaagaaactagtctgaactggttcttttaaaaatgcagtttgaactttgcttctaaagctgtatattaatttttgagagagaggcttgttttcaaggttaatttgttacaagattagtaaggaatagagat

SEQ ID NO: 360228 - DNA, 1359 bp, Homo sapiens
agcggagtgcggagccttaggcggagcgaagagaaccggtcgcggcaatcctagcgccgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaataaaataaaacagggtctgttacctagcttggaagatttgctgttctatacaattgctgaaggacaagagaaaatacctgttcataaatttattacagcactcaaatctacaggattgcgaacgtctgatcccaggttgaaagagtgtatggatatgttaagattaactcttcaaacaacatcagatggtgtcatgctagacaaagatctttttaaaaaatgtgttcagagcaacattgttttgttgacacaagcatttagaagaaagtttgtgattcctgactttatgtcttttacctcacacattgatgagttatatgaaagtgctaaaaagcagtctggaggaaaggttgcagattatattcctcaactggccaaattcagtcccgatttgtggggtgtgtctgtttgtacagtagatggacagaggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatggtaagaattacataaacattggttgaaaaaagaaatgtctcattttcctatgtaaatctaagtcgttttaaacattttttgattaaaattaaaagtatttgtcatgtgat

SEQ ID NO: 360229 - DNA, 315 bp, Homo sapiens
tattattagtagagatggggtttcaccatgttggccaggctggtctcgaactcccgacctcaagtgatacacctgcctcggcctcccaaagtgctgagattacaggcgtgaaccaccatgcccagccaagaaatggggatctggtttgctaataacccaacctaaaacttcaaacaagccttcttccacttccaacactttggaaattctgagggcctctgacagaggtgaaggtgataggcactgttatctgcaatgtaactggctcctcttggtgattacagttttcttatgttgaattttggataactttat

SEQ ID NO: 360230 - DNA, 5713 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
  misc_feature (4105)..(4105): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaacacaaacagaacgggcaggataaggactcttccataacaagactatgaagccacttccacatcaattccaggccacctaatcccatccgaggaggccatggggaggaggagggaggggagtgggctggggggagagtctgttttctgtgcactccctgtgactctggcctttcttcttctttttttaattgaccaatttttagttaaaaaggcaaaagaaggtgaatttgagatttacagaaaacagttccagtgtttggtttccgctgtctttcctttcatttgccatgtttttacattcttccaaatttggggtcactcccctagctcctgatgctgctactgtaccatccttttgctccagccatgagagcagacattgcagaatgttggttccaggttggcatgctctgaagctcttgaactgtagcacaggcagagccctttttcttcctgtcatctccacccgattccttccatccctacgtctaccactctctgggtcctcactggtcttcaaaggacctggctctcataggatcccctcaggattgtgtgcagggagagggggctttgctggggaggagctgggagtggagagttggagggtgggtggggttccctcatccagtttccacagcccaccatggctggagccaaatgctagaagcgagattgagaacagtggccgtttagtgatgtggtttacctaataccactgtccagctgtgcagctcagaaaggataaaccagtcagggacaggggccagaacaggtttgggaaggtggcagcaagcagagcatggtgggtaggagatgatccctaaaaaaactggagactgtggtggtctgagctggtcaggaatctgcagaatcccttccaggaatcagtgtgccagtgcccacagcagggtgagctaggagggagaaatcccaggaaaaaggtcgtgagaacccagaaagccactccatgaggaggcacggtgaccacagctgctaaaggttcttaggctgccttcctgggctaggaagagccccccagggagagcttccacaaaagggtatgtgtcaaaccttttgtcagaataaataatagcatttcccacccacccccatgccctgggccacagggacttggtgggatcagcacacccatggatcagcttttgctgtcttagagacagccatccccatgaaggaatggtaaggacagccactgctcagtgaagaacagccatttggaagagccacgctggagccctgcagccatagaactattcacactggagttttaaaagaaacagcaataccataagctctagtagggaatcataatcaggaaaggaattcacaacataaaataggtgttctgtgctattaatcatgtaactttgtatatgatgtatagcaaagatactgggaggttttgtttcatccttaaatcagaaatgaatgctagtttcatagctgggcagaaccctcatccccaccccaaagttttccttttctttcccnttcccccaacccaaagatcagactactgttaagtttcaccacacaattggaattgcaaagacgggaggcaaatggagtgattttcatcaatggaattgcactgacagtgagtgtttcttataggattactaaattttttaatataaaatgatttgtttaaaaatcaggagttgatattaagtaccaggacattagttcggatgatttcatttttatttctacagtgttaaaagtgcacttatatgctggtttatttacgtcttgggaaaagagactgcaaattgaagggatgattgttactttttctttttttaaaaaaaaaaggttaaggagattttaagacttataaatgtttaagaaattataaacaaggttagaccctttgaaaaaaagtttagaagatattcttaaagtaaatttttatagtgttaattttgtaataatttatgttttactatattacagagctaactgaccagaatagtttcagaaacaatatgaaacttaggaaagtttaagcaatgtttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttgaattggaagctggaataaagagcccccaccccccccccaccctcatcgaatgctgcttactttgtcaaaagactggctatgaccaaggtgaggatatttctggaaaactgggcaaaaagggaaagcccacagtattcttccttggcagtcaaccacaggtttactttacaatgatgtattaaaaacttgcagcttgaaaaatggaatgcaaataaaaggttctctttgggtttgtcttaatggagttaaactggagcagcctataaaacatttttagggtgatgtcctctgggtccttctgttctgcacacccactcagtcttctctcccagccccttgactgcacacacccctctttgcctgaagatctcctgacttgtcgccagccatagaggctcgaaagctctggttgtgaagcataacgcaatgcatagacctgtcagccataaaaaaaaaaaaaaaaaaaaaaaaaaaagcgacttggataacttgtatgccttcttttgtatcaatgtaccaattgtaaataatgctgatcaacctttgtagagaatagtttatacagcatattctattattgctgattctcagtgaactcttgttttaaaaaaggaaaaaaagaaattttctatttacaccttatattttgttatgctgtcggcccatggcactttaacaaaactctgtgggttttacgtagctggtcagtcatggggtatattaaataactgttgttgcacagacaagaa

SEQ ID NO: 360231 - DNA, 338 bp, Homo sapiens
gctttttcaaaacacacttgttttcatttcccccacagatatgcacttatttggccattacccagcacatgacgacttctatctcgtagtgtgcagtgcctgtaaccaggtcgtcaagccacaggttttccagtcgcactgcggtaagtggacccctgcaccgtcggccacatctgcagctgccgccctggggacagtcgccttcccctgggctccccgacagggtctcgccatgtcttgtctcagcctgaggctgtgggtaaagtcttcctgggctgctgcctctgctcgcaggctgttttaggagctgtagtccatctgctgaaatccgcagccct

SEQ ID NO: 360232 - DNA, 5591 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
  misc_feature (3983)..(3983): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggttgggaaaaatagcagcctagctttgtcacaatccagtccttcaagtatatccagcccaggacacagccgacagaacacaaacagaacgggcaggataaggactcttccataacaagactatgaagccacttccacatcaattccaggccacctaatcccatccgaggaggccatggggaggaggagggaggggagtgggctggggggagagtctgttttctgtgcactccctgtgactctggcctttcttcttctttttttaattgaccaatttttagttaaaaaggcaaaagaaggtgaatttgagatttacagaaaacagttccagtgtttggtttccgctgtctttcctttcatttgccatgtttttacattcttccaaatttggggtcactcccctagctcctgatgctgctactgtaccatccttttgctccagccatgagagcagacattgcagaatgttggttccaggttggcatgctctgaagctcttgaactgtagcacaggcagagccctttttcttcctgtcatctccacccgattccttccatccctacgtctaccactctctgggtcctcactggtcttcaaaggacctggctctcataggatcccctcaggattgtgtgcagggagagggggctttgctggggaggagctgggagtggagagttggagggtgggtggggttccctcatccagtttccacagcccaccatggctggagccaaatgctagaagcgagattgagaacagtggccgtttagtgatgtggtttacctaataccactgtccagctgtgcagctcagaaaggataaaccagtcagggacaggggccagaacaggtttgggaaggtggcagcaagcagagcatggtgggtaggagatgatccctaaaaaaactggagactgtggtggtctgagctggtcaggaatctgcagaatcccttccaggaatcagtgtgccagtgcccacagcagggtgagctaggagggagaaatcccaggaaaaaggtcgtgagaacccagaaagccactccatgaggaggcacggtgaccacagctgctaaaggttcttaggctgccttcctgggctaggaagagccccccagggagagcttccacaaaagggtatgtgtcaaaccttttgtcagaataaataatagcatttcccacccacccccatgccctgggccacagggacttggtgggatcagcacacccatggatcagcttttgctgtcttagagacagccatccccatgaaggaatggtaaggacagccactgctcagtgaagaacagccatttggaagagccacgctggagccctgcagccatagaactattcacactggagttttaaaagaaacagcaataccataagctctagtagggaatcataatcaggaaaggaattcacaacataaaataggtgttctgtgctattaatcatgtaactttgtatatgatgtatagcaaagatactgggaggttttgtttcatccttaaatcagaaatgaatgctagtttcatagctgggcagaaccctcatccccaccccaaagttttccttttctttcccnttcccccaacccaaagatcagactactgttaagtttcaccacacaattggaattgcaaagacgggaggcaaatggagtgattttcatcaatggaattgcactgacagtgagtgtttcttataggattactaaattttttaatataaaatgatttgtttaaaaatcaggagttgatattaagtaccaggacattagttcggatgatttcatttttatttctacagtgttaaaagtgcacttatatgctggtttatttacgtcttgggaaaagagactgcaaattgaagggatgattgttactttttctttttttaaaaaaaaaaggttaaggagattttaagacttataaatgtttaagaaattataaacaaggttagaccctttgaaaaaaagtttagaagatattcttaaagtaaatttttatagtgttaattttgtaataatttatgttttactatattacagagctaactgaccagaatagtttcagaaacaatatgaaacttaggaaagtttaagcaatgtttatatttttaaaatgttctttgaattatgtttttattgtacatttcttcagactgaaaagtatgtacatatctttgttatttttgcacaattttgtcttgttcggtttcagaggtctgttgttttttataatttattttgagttgtaaaacttgcaggagtaaaaacaaaaaacaaaatctccacaacaaaataaccctctgatttataaactcttatagtcaaagagggaaaacaaaggttgagagattaagtggctgcttctgagaaataatgtctcaaggactaaaggagcaattcaataggtttagacattgtagctctctacatcttgaattggaagctggaataaagagcccccaccccccccccaccctcatcgaatgctgcttactttgtcaaaagactggctatgaccaaggtgaggatatttctggaaaactgggcaaaaagggaaagcccacagtattcttccttggcagtcaaccacaggtttactttacaatgatgtattaaaaacttgcagcttgaaaaatggaatgcaaataaaaggttctctttgggtttgtcttaatggagttaaactggagcagcctataaaacatttttagggtgatgtcctctgggtccttctgttctgcacacccactcagtcttctctcccagccccttgactgcacacacccctctttgcctgaagatctcctgacttgtcgccagccatagaggctcgaaagctctggttgtgaagcataacgcaatgcatagacctgtcagccataaaaaaaaaaaaaaaaaaaaaaaaaaaagcgacttggataacttgtatgccttcttttgtatcaatgtaccaattgtaaataatgctgatcaacctttgtagagaatagtttatacagcatattctattattgctgattctcagtgaactcttgttttaaaaaaggaaaaaaagaaattttctatttacaccttatattttgttatgctgtcggcccatggcactttaacaaaactctgtgggttttacgtagctggtcagtcatggggtatattaaataactgttgttgcacagacaagaa

SEQ ID NO: 360233 - DNA, 3077 bp, Homo sapiens
cagggccctcatccaggagccaggaaacatctactaccacgagtcgcgttgcccagcgtgtgtcagcctccttatccaaacggcaaggcagcctccccgggatgtagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgacatcactgggcagggaggggaatctacttgatgccaagagaaccatgtttcttaaagccagaggacccgccttgatctagaaagataaattcagacaggccaagcacaaaggaagaagacgtgggcaactaaagcagcacaaaagaaacagagtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagcacagaaacccgagccacagggcatcaggtccctcccccctgttcaggacttgcctaaccaatctgctgtcactgagcaacattggggctgcctgggtgtcaactctggagagcgtagcaccccgctaccctctcaacctcgctgcccaaaccccaggccccggcgggcccgaacctggagggatggcagccgatgggggcgtggaagacattaggaagaaaaggaacggccaagactcttttttctttaacaagcatttaactctgcatcaggagccgccaacacagtattctctttcagccaggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggcagttttcaccctctgctttgagagcactttactgaacaagtacttgataccacgctcactatgtgctagacactgttctcggcactttacggttgttacctcactgagtcctcacgacaccccagtgcagtgagtgcagttatcactttacagatgagtaaactgaggcacagagagattctgagttccccactccacatcggtcagttttatcttttgaggttctgagaacattgtcattaaagagttctgttgctaaaaaaatt

SEQ ID NO: 360234 - DNA, 1132 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgccgggcctgcaactgttccaccttctggatcctccttcagcttctctgactcctgggccaggtgtgtgcatttagctccatgctgaagagctgcagcttctgcaggacatttgtaccatcgaggtcaaaggcaacaagaagtgacatgagtttcagtccatcttcatgaggttccagttaaggcctgtgaattcgcaattgttcttcccgactgcctgtcctgtgaacctcacatactcacatcagatgcaaaaacaaccaccttgtagaagctgcttaaccagctcttactattgcaaaaggtcaatacctgaaataaattcatgtaaatgctgatagatatgtctgtactgtattaatccttgtgttctgcttcttcccttgagagctgatatgggtggttttcaagattatggttgtttgaaggattgctatctaccgaaggaggcccagtataagaaagagattccagtgattttgatccatggaaaggcagagctgacggctccctgtctctacccccacatccccagggggacacctgaggggcaccctttgaaaatccttggtagatgagtagtcttcaagtctagtggtaaatgggaggcccctgaggagaatctgaaaaatgcaaattcctgggtttacctcagatccagaaatccagctatcaaatgaccaatctgaaggtgagactttttttttttctttgagacaggatctcactctgttgccc

SEQ ID NO: 360235 - DNA, 761 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgcattgaaggaaaaaacaacagtgaggcagccagtcaacttgaagcaacgaaagtgggttgcaggagctatgagagaagccagtttgaaaatcacattggaaccagatcgtggaaggctttgaatgcaaactgaggaaaaggaaaagccgcttgccaaaggagtgattgataaaatcatctctgaagctttttgaaataaagaagtggagaccctacctgagacctgccaagtcagaagccccacaagtgatctggtgctgcccagatgaaatcaacctaatgctgtctactactttctttaatatccaaggatatgaaagatattaatccagggatattaagggatacaacctctcactcttttt

SEQ ID NO: 360236 - DNA, 623 bp, Homo sapiens
ggagatacgcaccgcgcggggaacccgggggtccgggggccctaacttttgagttttgcacgccccgcagcctgagatgggaaggtagctcgtcgcgctccaaactcacctgcgtttcagaacgacatctacccactggtttcagctcctagagcaacaactgcagaatctccatggtccaaagtcctccagaacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagcatggaaatacggtacctgaaatgggacacactgagtagataggtcatcccagaccaagatatgcaagagaagccacaacctgctgcaattgggcatcaaacacatatggtcgtcataaataaatcatatcctgttctcatttgcaagcctgcc

SEQ ID NO: 360237 - DNA, 904 bp, Homo sapiens
  misc_feature (840)..(840): n is a, c, g, or t
  misc_feature (848)..(849): n is a, c, g, or t
  misc_feature (854)..(855): n is a, c, g, or t
agcggggcaactgccactccaaggagaacagaaatggttccgttattagtggctgctgtgggaccacgacagtctgtgggagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgacatcactgggcagggaggggaatctacttgatgccaagagaaccatgtttcttaaagccagaggacccgccttgatctagaaagataaattcagacaggccaagcacaaaggaagaagacgtgggcaactaaagcagcacaaaagaaacagagtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagaacattcggttaagcntcggaggnngtccnnggcggaaaagcaatttacttctctggagacaaaagcaagtcggggaaag

SEQ ID NO: 360238 - DNA, 3214 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagcacagaaacccgagccacagggcatcaggtccctcccccctgttcaggacttgcctaaccaatctgctgtcactgagcaacattggggctgcctgggtgtcaactctggagagcgtagcaccccgctaccctctcaacctcgctgcccaaaccccaggccccggcgggcccgaacctggagggatggcagccgatgggggcgtggaagacattaggaagaaaaggaacggccaagactcttttttctttaacaagcatttaactctgcatcaggagccgccaacacagtattctctttcagccaggaagatccctcctgcggcagatagccccctgccctcgccagcagcccacatcaccacccccgttccagcatccgttttgcagcctttcagcaaccccagtgctgtgtatcttccttcagctcccatcagctcgaggctcacctcttcttacataatgacatcagccatgctctcaaacgcagctttcgtgacatcgccggacccgagcgccctcatgtcccacaccacagctttccctcatgtggccgcaaccctcagcatcatggactcaaccttcaaggccccatccgccgtgtccccgataccagccgtcatcccttccccatcccacaagccatccaaaaccaaaaccagcaaatcctcaaaagtcaaagacctgtccacccgtagcgacgagtctccaagtaacaaaaaaaggaagccacagtcttcgacttcctcctcctcctcctcctcctcctcttccttgcagacatccctctcgtctccactgtcagggcctcacaaaaagaactgtgttttgaatgccagttctgctttgaactcctatcaggcggcccctccctataacagcctgtctgtgcacaactcaaacaatggggtgagcccactcagtgccaaactggagccctcaggacggacctcgctgcccggcggccccgcggacatagtgagacaggtgggcgcggtgggaggcagcagtgactcctgtcccctctctgtgccctcccttgcgctccacgcaggggacctctctctggcctcacacaatgctgtgtcttctctgcccctctcttttgacaaatcagaaggaaaaaagcgtaagaactcgagttctagtagcaaagcctgtaaaatcactaaaatgcctggtatgaatagcgttcacaaaaagaacccgcccagccttctcgcaccggtgcccgatcccgttaacagcacctcctctcggcaggtaagggacctcctggcaccgccttcaccggctctggggggcagggggagctgggcagcgcccctgcttagccgggcggctccgacaggtaacacaagcttgattcctgttctcgttttccccgaaggcagttttcaccctctgctttgagagcactttactgaacaagtacttgataccacgctcactatgtgctagacactgttctcggcactttacggttgttacctcactgagtcctcacgacaccccagtgcagtgagtgcagttatcactttacagatgagtaaactgaggcacagagagattctgagttccccactccacatcggtcagttttatcttttgaggttctgagaacattgtcattaaagagttctgttgctaaaaaaatt

SEQ ID NO: 360239 - DNA, 1668 bp, Homo sapiens
  misc_feature (9)..(9): n is a, c, g, or t
  misc_feature (11)..(11): n is a, c, g, or t
  misc_feature (34)..(34): n is a, c, g, or t
  misc_feature (39)..(39): n is a, c, g, or t
  misc_feature (42)..(42): n is a, c, g, or t
  misc_feature (54)..(57): n is a, c, g, or t
  misc_feature (63)..(65): n is a, c, g, or t
  misc_feature (69)..(69): n is a, c, g, or t
  misc_feature (79)..(79): n is a, c, g, or t
  misc_feature (84)..(84): n is a, c, g, or t
  misc_feature (90)..(90): n is a, c, g, or t
acttgaacncnggaggtggaggttgcagtgagcngagantgngccactgcactnnnncctggnnnacanagcaagactntgttnaaaaanaaagaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgagagaagacacggttcaatgtgtagaccttctccctctccagtgtctccagcctccaatcccaggacatcactagtacaggtgaaaacaaaagcctgtctcagcggccatcactctgccagcagcacctcaaagccattcaaaacgcccaaagacaatctacttacctccagcagcaaacagcacacagtctttcctgcgaaaggatcaagggataaaccatgtgttccagttcctgtagtcagtttagagaaaattcctaacctagtgaaggcagatggtgccaatgtcaaaatgaactccacaaccactactgcagtttctgcctcctccacctcgtcctctgccgtctccacccctcctttaattaagcctgtcctgatgtccaagtcagtgccaccttcaccagagaagatcttaaatggcaaaggaattctgccaaccaccatagacaagaaacaccaaaatggcaccaaaaacagcaacaagccttacaggagactttcagagagagaatttgacccaaataaacactgtggagtattggatcccgagacaaagaaaccttgcacaagatccctcacctgcaagacacattcgctaagccatcggagggcagtcccaggccggaaaaagcaatttgacctcctcctggcagaacacaaagcaaagtcccgggaaaaagaagttaaagataaagagcatctcctgacttccacgagggaaatacttccaagccaatccgggccggcacaggattctctgctagggtcttcagggagctctgggccagaaccaaaagttgcatcccctgcaaaatccagaccacccaactctgtacttcctagaccatcatctgcaaatagcataagcagcagcacatcttcaaatcatagcggccacactccagagcccccactcccaccggttggaggtgacctcgccagccgactgtccagtgatgaaggggagatggacggagccgacgaatccgagaagctagactgtcagttctccacgcaccaccccagacctctggcgttttgctcatttgggagtcgcctcatgggacgagggtactatgtgtttgatagaagatgggatcgttttcgattcgcactaaactccatggtagaaaaacacctgaattcacagatgtggaagtaagtgagcagcttttgtgcaatataagatccaagctgccccacagttacctgaaacttaactttctaaataaatgtcagtggctgacttttcatagaacaaaatgatt

SEQ ID NO: 360240 - DNA, 807 bp, Homo sapiens
ggagatacgcaccgcgcggggaacccgggggtccgggggccctaacttttgagttttgcacgccccgcagcctgagatgggaaggtagctcgtcgcgctccaaactcacctgcgtttcagaacgacatctacccactggtttcagctcctagagcaacaactgcagaatctccatggtccaaagtcctccagaacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggaggttatgaggcttaataaagaagatatgcacttatttggccattacccagcacatgacgacttctatctcgtagtgtgcagtgcctgtaaccaggtcgtcaagccacaggttttccagtcgcactgcgggagaaagcaagacaacaggagaaatgaaggcatctccaggagtggaccagagagcagccaagccatagagaagcatcaggtgtgagaatggaaaacgcagaagagacgtacaacttctgaaagatctcagaggactggcattgtctggagacggcttcctggaagaggagactccagcagagccctgaagtgtggacaagcttccattcactgcaaattcgtgagcacactc

SEQ ID NO: 360241 - DNA, 516 bp, Homo sapiens
aaaagcaagatgggagaacttattctgctagatgtcaagatctattataaatagaaattcagacagtgtggtattgactcaaagatagaagattagaatggaacagaatagagagcccagaaaggactcttgcatacacaaacatttgctatctggccaaagtggtgctgcagagcagacaggaatggacgttcttcttaataaatgacactgacatatccatatgaggaaaaagttaaattggatccctacttcacaccatacattaaattccaggttgattaatgacctaaatagaaagagaaattcagaaagctttaggtgattagaaagttagacagctcttatgaccttgagggaggggaaaacttaaacaagacttaaaaagcattagccacaaaggggggaaaagctataaagagagcaaaaacaaagccatgatgggagaatgtataaataaaaaaataactctccaaaataaatacttctaaacagagggaatatatatcgaactac

SEQ ID NO: 360242 - DNA, 785 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaa

SEQ ID NO: 360243 - DNA, 906 bp, Homo sapiens
  misc_feature (793)..(793): n is a, c, g, or t
  misc_feature (796)..(796): n is a, c, g, or t
  misc_feature (805)..(805): n is a, c, g, or t
  misc_feature (815)..(816): n is a, c, g, or t
  misc_feature (868)..(869): n is a, c, g, or t
  misc_feature (906)..(906): n is a, c, g, or t
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaacaaaaaanaantggccgcgnttaacacggnngactgggaaaccctgcgttaccaactaatcgcctgagacatccccttcgcanntgcgtatagcgagaagccgaacgatcgccttccacan

SEQ ID NO: 360244 - DNA, 544 bp, Homo sapiens
atgagtgctgtagatgacatgatagcaggtatggggttgtctgtcaggaaagtataacttaaatgtttataaagtttcacatacttctctttatattctataggtaatgtagatttgttgacactgctttgatttaaaataaatggaaatgtatagaaattttactttttatattaatggaaaacctgaaaagtgaaagaagaaaaacataattattatagtagacaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaa

SEQ ID NO: 360245 - DNA, 383 bp, Homo sapiens
  misc_feature (30)..(30): n is a, c, g, or t
ctccgcggctactggcgatctagccactgnggatttcccgggttgcttgaattcggcacgagggattttggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaa

SEQ ID NO: 360246 - DNA, 692 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaa

SEQ ID NO: 360247 - DNA, 1556 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaagctttccgaatcatttttgaagaattcagaaacttgattgaaaagcttattccaactatgatctgacactcaagactgtcagatttaggttgctgttaattttgtcatgagaatgtaaaatactaaaatctctaagtgaaaaattttgcatactagtgcttgttataaaggataatgcaaaaataaacttgggaactttgca

SEQ ID NO: 360248 - DNA, 1060 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaaaaaaaaaaaaagggggggccgcttttttttttttataaagattataagtataaaagggggacgatcgggtaagagagtaggcgtggataaggggcgatgaagtggtgggggagggggatggaaattggttttggcttgcacatgagttggaaactctttaatcgcatttttttggaaaaacaacaaaataagg

SEQ ID NO: 360249 - DNA, 1619 bp, Homo sapiens
tggggtgggtatggggacaattctactcttcccagtcattcagggactggcaggctaacagaatctatcttaaacacatggctgaaactgaaattgaataatctgtcttaaaactatacagcttgtcagtggaggttccaagattcttaccacttggttctggcttcaatgcccatgcctttttgcccacatctatatcaagaattgaaaagacatctggaccagctgcctagccaaagtttgtattctgtattcagtatgtaagccaatcagaaaactggtgattgcgtaacacattcagttgctgggggtacattacctccttatctggaactgcagatgtttccttgcaacttctttctggggcctccatttattggggtcatacaaaataaaagattatccctttatcacttagagaacacaattttcgtgccctttttgattattttgtttctgagtgaaaatttccctattatttcactataccttaaaattttgaatactgattgttcagatttagtcagcttctactttgtctagggtccttttaaagggaatgccagaactcaagtacattttccatgtgagatctgatgaacatagaacagaatagaactatcacctctgtagacttaagatttttgtactaactgtatctttgttttcctagggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaagctttccgaatcatttttgaagaattcagaaacttgattgaaaagcttattccaactatgatctgacactcaagactgtcagatttaggttgctgttaattttgtcatgagaatgtaaaatactaaaatctctaagtgaaaaattttgcatactagtgcttgttataaaggataatgcaaaaataaacttgggaactttgca

SEQ ID NO: 360250 - DNA, 1031 bp, Homo sapiens
ccccttaatatcacttacaccccgcccacaaaaaaaaacaacttaggaaacctatggcatagttgaaagagtccaaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaagctttccgaatcatttttgaagaattcagaaacttgattgaaaagcttattccaactatgatctgacactcaagactgtcagatttaggttgctgttaattttgtcatgagaatgtaaaatactaaaatctctaagtgaaaaattttgcatactagtgcttgttataaaggataatgcaaaaataaacttgggaactttgca

SEQ ID NO: 360251 - DNA, 724 bp, Homo sapiens
gcatcgacatagaagaataatccttaacagtctgcatactgacattagattacagaatgttgacaatttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaagctttccgaatcatttttgaagaattcagaaacttgattgaaaagcttattccaactatgatctgacactcaagactgtcagatttaggttgctgttaattttgtcatgagaatgtaaaatactaaaatctctaagtgaaaaattttgcatactagtgcttgttataaaggataatgcaaaaataaacttgggaactttgca

SEQ ID NO: 360252 - DNA, 867 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaa

SEQ ID NO: 360253 - DNA, 928 bp, Homo sapiens
  misc_feature (787)..(787): n is a, c, g, or t
  misc_feature (815)..(815): n is a, c, g, or t
  misc_feature (818)..(818): n is a, c, g, or t
  misc_feature (827)..(827): n is a, c, g, or t
  misc_feature (837)..(838): n is a, c, g, or t
  misc_feature (890)..(891): n is a, c, g, or t
  misc_feature (928)..(928): n is a, c, g, or t
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaacnaaaaaccctccctcgccttccaaaaaanaantggccgcgnttaacacggnngactgggaaaccctgcgttaccaactaatcgcctgagacatccccttcgcanntgcgtatagcgagaagccgaacgatcgccttccacan

SEQ ID NO: 360254 - DNA, 774 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaa

SEQ ID NO: 360255 - DNA, 1014 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtgagtgacagacctctccggtcccccccaacacatcccactgctgccggcagcctgaacactgaacgtccgctccctgcagccacaccaaggactgataacgctcagtgctctgggacactggccagtcccgagagtcctcctggagtctcgggaggcaggagtccaggaatatgtatggctttgagagaatcatgccttttactgtcaagtacagtggacgggggcgaattttaatacttaggttttccaggacgctgcacgtttggttctcttttgactgtagaaatcttccctcagaataataaccaaggactcgctagaattaaaattctgtgatttaagtatttgaggacacttgtctgacttttaagtgtgaggttctagagaccaagtaacacagtatccaaccaccagagggcacagccagcccctagctgatagtacagccccatgtgatccccgtaaaagacagggtcctgttggtatgccttgtgagtcacattcaagagctacctttctaaactaccgttctgtacttt

SEQ ID NO: 360256 - DNA, 1511 bp, Homo sapiens
aggccccacaactacgagtactccttgtccccacccggtcctaatttggtcgggtatagcggaggtgggcgtagagagaactggaggtggagacctttgtgcatgcccacacactgctttcctcgcgaggaatctggggcccttgcagaggcggaaccaggatgtgacgtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaagctttccgaatcatttttgaagaattcagaaacttgattgaaaagcttattccaactatgatctgacactcaagactgtcagatttaggttgctgttaattttgtcatgagaatgtaaaatactaaaatctctaagtgaaaaattttgcatactagtgcttgttataaaggataatgcaaaaataaacttgggaactttgca

SEQ ID NO: 360257 - DNA, 1712 bp, Homo sapiens
  misc_feature (865)..(865): n is a, c, g, or t
cggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggacgggcatggcgactttgcggagaacacctggagaccccgggatagtttggaaccaatgtggtacatttcaacgccccccggaaaagcgacgcccaacggggcccaaaggaccggcgaacctaggggcccccacaaggggcgggcgcgggcacaacaacagtgtgacaagagccggcgcgagaaccaattgtcggggtcccaccccacacaagtgtagcaaaggccgtcgagagcagagaccaccatcccggtagagaggaagagcacactancttattaatccagataagaagactttacatacttttctactctcactgacatacacaaccaaccacacctacacgcgaccccacacaacaactctcacctccctcacgtccatcactcatcaccaccgccacccgacacccatcacccaccccactcctcgacacacgcacctgtccggcttcactatagcacccatcacctagaccagcacaatcagcacaacgaaagcgacacactcgaggcatgcccacacccgaccgcactcccacccgcagcgggcaaagggaacgtacgacggagcagcgcagagaacgcgaggagaacgaagcggagggaggcggaggcgagagatgactcagggctgcgcagacacgcgaggaggcgagggcagcaacggacggacgacagagaatcaagcggacgaacgggactaaaaccgacggcggaagaggcagcacgccgagcggccgagggcagacggaacggcggcgaagcacgcatgcggagcgaagtggacgaagcacacggacgaccgcgaccagacgaccaaaagcgcagccacgcagaggacggacggacggcggcgcgatgaagagagatagagcaggcagagcaggaggcagaaggaaggagacacacgaagagcggaacggggaaccgcatggggacgggacggcgagaacgaggccaaacacggaggacagagacgaaaggacgccacgacgacgacaccccacacgaccgagaacaccgaaccaacaccgacacgaagacgacgcgaccaacgagcagagagacagcagccagagtcaacccgcaacagacgcacaccaccaacccacacca

SEQ ID NO: 360258 - DNA, 1293 bp, Homo sapiens
  misc_feature (1293)..(1293): n is a, c, g, or t
cggtcctaggggtgcttccgtggtcggcggctgctgggctccgcgccggggtccgagtcccacgaagccccggcccgagccgccggatgcccgcgcgcagcggggcccaggtcatgcagcctgggcccccatgcccgtgcagctcgcacatatgtggggcagagcagccaccctgcccccagcagcagccgtccatcgtcagacgtgatcatttcctgaggcctcgagtgtgtcagggtgtttgtgcctcataacaacccacaggatggtcacccccgctttgcagatgaagaaaccaaagcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaaacacactacaaaaaaaactcagactagttctctctccctcgttgccgaattcggcacgaagn

SEQ ID NO: 360259 - DNA, 1115 bp, Homo sapiens
  misc_feature (1115)..(1115): n is a, c, g, or t
cctttctgtaggaccaggtgtcacactcatctgagggctccagacacatggcctgtgcgtctgtcctgcccagcgtctcccacctgacgcggccaggtgcccagttgctcttcaaggccttttcagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaaacacactacaaaaaaaactcagactagttctctctccctcgttgccgaattcggcacgaagn

SEQ ID NO: 360260 - DNA, 1052 bp, Homo sapiens
  misc_feature (1052)..(1052): n is a, c, g, or t
cggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaaacacactacaaaaaaaactcagactagttctctctccctcgttgccgaattcggcacgaagn

SEQ ID NO: 360261 - DNA, 1099 bp, Homo sapiens
  misc_feature (1099)..(1099): n is a, c, g, or t
cggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaaacacactacaaaaaaaactcagactagttctctctccctcgttgccgaattcggcacgaagn

SEQ ID NO: 360262 - DNA, 1038 bp, Homo sapiens
cggtcctaggggtgcttccgtggtcggcggctgctgggctccgcgccggggtccgagtcccacgaagccccggcccgagccgccggatgcccgcgcgcagcggggcccagttttgccgacggatggggcaaaagaagcagcgaccagctagagcagggcagccacacagctcgtccgacgcagcccaggcacctgcagagcagccacacagctcgtccgatgcagcccaggcaccttgccccagggagcgctgcttgggaccgcccaccactccgggcccataccgcagcatctatttctcaagcccaaagggccaccttacccgactggggttggagttcttcgaccagccggcagtccccctggcccgggcatttctgggacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaacggcacgagctcgtgccgaattc

SEQ ID NO: 360263 - DNA, 3699 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360264 - DNA, 3243 bp, Homo sapiens
  misc_feature (3065)..(3065): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattgaattgggccctgttgtttcctgggatcttggggctgggggtgcccaacagcctggcatcttcttgtttctctgtgtgtttactcattcattcatttattcagctgataaatattgactgatgccagctctgtgccagncacattggacatgggggatacactagtgggcagaaatagccccgtcccagagccggccatggtggctcatacctgttataccagcactttgggaggctgaagtgggaggatcgcttgagcctgggagttcaagaccagcctgggcaacatggcaagaccctgtctctactaaaaatac

SEQ ID NO: 360265 - DNA, 1186 bp, Homo sapiens
cactgggcgtctgaagctcagagctcacccctgagatgggctctcctaggcctcctgggatgagggagccaccaggacccagtgctgtgatgcctgctcttccctctaccagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacacagcccttttcaaaaaaaaaa

SEQ ID NO: 360266 - DNA, 553 bp, Homo sapiens
aaggagtctagacatgaatgaggtctaaaatgagaattgtgactcctgagttcttcccactgtatgcctacccagcagcaggtgatacgtttttacaagccaaggtaatggtgttgtaggaagagcacaggctttggaggccaacggacttgggcttgaatcatggccctaacctttgccaaatgctctgtgccacacatgggctagggtctttgtgcctgtcagctgaggctcagtaaagttaagcgcctgatgttaaggtcagacagctgggaagtgaaagattcagggtttgtgaagtgcctagcacacagtgtcaaacccaaaataggcccccggtaaacccaagggaaatgtgagttcccttctccatcttcccctcctttacagggctgaaggcctctgaaagaacgctggtgcagaacgactggatggaggagaaggtccctgtaattgttgcaaccattagttttgggatgggagtggataaagccaatgtcaggtgagctttggttcttgccctgcctgcgaacctatgagaggatcctctaga

SEQ ID NO: 360267 - DNA, 3055 bp, Homo sapiens
aaggagtctagacatgaatgaggtctaaaatgagaattgtgactcctgagttcttcccactgtatgcctacccagcagcaggtgatacgtttttacaagccaaggtaatggtgttgtaggaagagcacaggctttggaggccaacggacttgggcttgaatcatggccctaacctttgccaaatgctctgtgccacacatgggctagggtctttgtgcctgtcagctgaggctcagtaaagttaagcgcctgatgttaaggtcagacagctgggaagtgaaagattcagggtttgtgaagtgcctagcacacagtgtcaaacccaaaataggcccccggtaaacccaagggaaatgtgagttcccttctccatcttcccctcctttacagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360268 - DNA, 3195 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360269 - DNA, 2334 bp, Homo sapiens
cctctgcggtgctgcctgctccaggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360270 - DNA, 3903 bp, Homo sapiens
  misc_feature (3760)..(3760): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcccccaaaaaaaaaaaaccacgaaaaaaaagggggggggttaaaatcccggggggcccaatnaccgccccgtttttggacaagggccccaggggggatataagagagcggggcgctcaagtgcgggggaaacgcggcattgaggacacctgggggcagggcccccagagtagccggaaaacggttgggaccgtgggggagcgtaa

SEQ ID NO: 360271 - DNA, 2189 bp, Homo sapiens
  misc_feature (2151)..(2151): n is a, c, g, or t
  misc_feature (2153)..(2153): n is a, c, g, or t
  misc_feature (2168)..(2168): n is a, c, g, or t
  misc_feature (2179)..(2179): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggctgttgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattccaccttgcaggntncgagctcaatcgtanctggctgcgancccgggggaa

SEQ ID NO: 360272 - DNA, 3221 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatcagcaggtgaggcccaggatgacccatgctagaatctgggggaggactgcggccctgcccagccagcagttggtcacctctggggccacacagccatgccaggtcgagc

SEQ ID NO: 360273 - DNA, 3495 bp, Homo sapiens
  misc_feature (3317)..(3317): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaaggggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggctgttgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattgaattgggccctgttgtttcctgggatcttggggctgggggtgcccaacagcctggcatcttcttgtttctctgtgtgtttactcattcattcatttattcagctgataaatattgactgatgccagctctgtgccagncacattggacatgggggatacactagtgggcagaaatagccccgtcccagagccggccatggtggctcatacctgttataccagcactttgggaggctgaagtgggaggatcgcttgagcctgggagttcaagaccagcctgggcaacatggcaagaccctgtctctactaaaaatac

SEQ ID NO: 360274 - DNA, 1315 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaataaagttgtgttgttgtggggcatgcaggcgtgcacacagcccttttcaaaaaaaaaa

SEQ ID NO: 360275 - DNA, 3710 bp, Homo sapiens
  misc_feature (3532)..(3532): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggctgttgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattgaattgggccctgttgtttcctgggatcttggggctgggggtgcccaacagcctggcatcttcttgtttctctgtgtgtttactcattcattcatttattcagctgataaatattgactgatgccagctctgtgccagncacattggacatgggggatacactagtgggcagaaatagccccgtcccagagccggccatggtggctcatacctgttataccagcactttgggaggctgaagtgggaggatcgcttgagcctgggagttcaagaccagcctgggcaacatggcaagaccctgtctctactaaaaatac

SEQ ID NO: 360276 - DNA, 3891 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgatatcttagggtgaagagagggaggtgtcggccagccaagagagaaaattgcggatcttgggctcaggaagacgggagaaggggttcggggtcccggggtggaagaacggtcgtcgtggttgcgcttatagaagtaggagcagagggttctcgtggcaaccttttactacctttgccttaacctttggccactgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360277 - DNA, 4040 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgagtgagttccacgatcactgggctgaggagcactccaagctctcgttcccttggagactgcaggaccctgtcaaccctggcctgtttgggccacctctccccagattgtacctctcctactccaggggactgcccctacaaccccaccagggccaggcatggctacaacttaggtgctaccagcagctgctgagggacagtaagccacagggtgctcagagagccctaatcagaatccctgtgcccaaggcctaccccaccaggcctggagtcccgcaagagctcagcagggagaagcccaggcccacctgataccttgtgcctgttaccttgcacccacagagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360278 - DNA, 2094 bp, Homo sapiens
cgactctagaggatcccccattggatacggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360279 - DNA, 3762 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaaggcctcctgggatgagggagccaccaggacccagtgctgtgatgcctgctcttccctctaccagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgc

SEQ ID NO: 360280 - DNA, 3723 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacgactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagttcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacacagcccttttcaaaaaaaaaa

SEQ ID NO: 360281 - DNA, 2255 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtacgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcggtgagctgtggcccagtggcctccagacctgtgaccaggaaaggcttcacttcccctctgccctcaggggtgcacctcttgccaaggcctggctccccaccagggtcctgcctgcctcttccctcccacactcctgagagccccgtcc

SEQ ID NO: 360282 - DNA, 1542 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtgagctttggttcttgccctgccctcctggtctgggcctggctcagggtggattgcctagtgctgtgcccaaaggaccaggtgcatgtgctccttcgagggctagaggggaaggaagctccaggagagagtccttagaatacagcctgaatgctgacagctcctgtgcggcctgctcccaggtgactgcacggcatggttctggcaccccccaggatggggcagcatgcagtctgtcaggcttgtcctttaacatagtcctgttcactcacatctcagtaggtggatcctatgaggaggtgggaataaaggaactatagtcatgcacctcatgttgatgtttcggtcaatgacagactgcatagactgagatcctgtaagattgtaatggagttg

SEQ ID NO: 360283 - DNA, 1269 bp, Homo sapiens
  misc_feature (1036)..(1036): n is a, c, g, or t
  misc_feature (1057)..(1057): n is a, c, g, or t
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcaggntgaaggcctttgaaagaacgntggtgcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacacagcccttttcaaaaaaaaaa

SEQ ID NO: 360284 - DNA, 5471 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360285 - DNA, 5564 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360286 - DNA, 6689 bp, Homo sapiens
  misc_feature (1486)..(1486): n is a, c, g, or t
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagacatccacacgttcctctgctaaaaccttgaaaaataggccttgccttagccccaaacnccccactcctggtagctcagaccctctgatccaaccctccagccctgctgtgtgcccagagccaccttcctctcctaaacacgtctcttctgtcacttcccgaactggcagttctggagcaaaggagatgaaactcaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360287 - DNA, 5071 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360288 - DNA, 5738 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagatgtgacagcacccttagtggatgagggagctcccggcaagcaggctgccgcgcagccccacacggagatcccagaaggaaccacagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360289 - DNA, 5420 bp, Homo sapiens
  misc_feature (25)..(25): n is a, c, g, or t
gctaggtagaggctgggtgtgaatnggcgaggcacttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360290 - DNA, 5651 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360291 - DNA, 5393 bp, Homo sapiens
aagcagctggtacggtctgggaagttaggatccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360292 - DNA, 6131 bp, Homo sapiens
atgagattagcgcccacgtccagcctggaccctgcggagaggcctctggggtctctgggccgtgcctcggggagaaagagccagaagctcccgtcccgctgaccgcgagccttcctcagcaccgtcccgtttgcccagcgcctcctccaacaggaggccctcaggagccctccctggagtggggacaaaaaggcggggactgggccgagaagggtccggcctttccgaagcccgccaccactgcgtatctccacacagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360293 - DNA, 4488 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360294 - DNA, 646 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagaatctcccctgcagacccccactgaggacggatctgaggaaccgggctctgaaacctctgatgctaagagcactccaacagcggaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggccttgtacggggtaccgagct

SEQ ID NO: 360295 - DNA, 5017 bp, Homo sapiens
  misc_feature (1580)..(1580): n is a, c, g, or t
  misc_feature (1843)..(1843): n is a, c, g, or t
  misc_feature (2129)..(2129): n is a, c, g, or t
  misc_feature (2693)..(2693): n is a, c, g, or t
  misc_feature (3024)..(3024): n is a, c, g, or t
  misc_feature (3242)..(3242): n is a, c, g, or t
  misc_feature (3244)..(3244): n is a, c, g, or t
tggagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcaagggctggcagggaggggaggggtaagagaaacaggaaggttcttactgagtttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcntcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcaganagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcngtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtntagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaaggtcagtgaactggaattgcctgccatgacttgggggttggggggagggacatggggtgggctctgccctgnaaagatcatttggacctgagctctaattcacaagtccaggagattttagggagttggttcttatcaaaggttggctactcagatatagaaagagccctagtggtttttttctaataccatttctgggtaattcctaaggcatttagtgttctgaaagatgctagccttgtccagcctgggagttgagaatgaatgtctaacagaaactctaggccggncntggtggctcacgcctctaatcccagcactatgggagacccaggtgggcagatcacctgaggtcaggagtttgagaccagcctggccaacatgtgaaatcctgtctcactacaaataaaaaaattagccgggtgtggtggtaggtgcctataatcccagctactcaggaggctgaggcaggacaatcgctcgaacccaggaggtggacgttgcagtgagccgagatcgcatcattgcactccagcctgggcaacaaaagcaaaactccgtctcaaaaaaaaaaagaaactcaaatatgtgtgacaggcgattctcactgcaggctgccctgtggctgatccaggagcaaggccttaaccatgtcatccccaagcgattgcttgtaaactttcttctgtgcagccttcaacccttattatgattttcttctcaggaaccaaactgctgtattcaagaaaggcagctttgtgtaatcatttatcataaatatcttaagaaaaatcctagagattcctaattttaggaaatgggagacctatggtactgatataatgtgggctgggcttgttttctgtcatttgctagataaatgaacttgagagcctactgtaaaatgtggaagcttctagattgcagaagggctggaaagacactgttcttttctcccgagtgatgggatctgtccagtatttagagctgcctctgaggccatctgattctaggagactctgcctcgttgaggatattttgaggcctaactacacattcctgcccccagagaggtcacagcctatagcaggctgatgtttctcatgtcacatggcacagaaaggcacattttcgttctcaggctaacaaagagcttcaaaaactattagaagggacagtggctataagagaagaacctcagtcaatgtgtgaaattaactaggaacctggctcctgtttcttttaggtcatgtttttcagcttaggtaaaactagaggctttgataaagcatgacctctagaaatcattgcttttcataaatggaagtgggtttgagttttttctactgattgtagtgcaggtgatgtctacatgcccccagaacatattccatgcaacaaaaaaagcccaggtcaccgtctttgctgggaacttgacttttgtgctcactgaattttaagctttctgacagcagcctggaatcatggagggataaagtacctattagtaagatggaaaaaggtgtttcaggttggagctgcagtctgttgagagtaagctatgggaaggcctgtatacgaggggtggacttttcttctgtaagtgtccagagaccaggcctcctgaagagggcatgggggcttaacttacctggactactgtgtttacaatactcatttatcttgaactcctcctaacccctgagaattgctacatttagtatttgctgagtacttcctagcatcctagggaatcaatagaacattctcccaaccaggctgggtgcggtggctcatgtctgtaatcccagcactttgggaggccaaggtaggcagatcccttgaggccaggagtgcaagactagcctggctgacatggtgaaaccccgtctttactaaaaatacaaaagttagccaggcatggtggtacacacctgtaatcccagctacatgggaggagtaggaggcaggagaattgcttgaacctgggaggtggaggttgctgtgagccgagatcatgccactgcactccagcctgggcgacagagtgagtgagactctgttt

SEQ ID NO: 360296 - DNA, 5511 bp, Homo sapiens
  misc_feature (3510)..(3510): n is a, c, g, or t
  misc_feature (3523)..(3523): n is a, c, g, or t
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggagagggccggtctcacgcttggtagacgagaagggcgctgaaggcactagggaattaggagaacctggaaacgcgagatttagattntgtcccccctttntccctatactttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360297 - DNA, 5930 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaaaaaaaaaaaaaaaaaaaaaaaaaaaaaaaaaaaaaaaagggggggggcaaagatacccgggggggccatagctccgttcttgtcacaagggggccccaataggcaactccgtttaataaacgcaaggccactgggccccgccgtataaacaagcctttcgcgactaggcggaaaacttcgtccgcctgggcgactcttgggaaggcgcaccccttacatctcgcggggggaggaacaccactaaatgtttccgaccacaacatcacccctatcgaaacattttcaagcactccccagcggggtcaactaataaccactctcccaacgcgcctctataacgctggcgcacaaccccacacgccggcccattatcgcactcgcgcggcttacaagaagtcctggccataccgagagattcacatcttagcgaaaacttatcatcacccggatccattgata

SEQ ID NO: 360298 - DNA, 4837 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagaccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360299 - DNA, 8826 bp, Homo sapiens
  misc_feature (1580)..(1580): n is a, c, g, or t
  misc_feature (1843)..(1843): n is a, c, g, or t
  misc_feature (2129)..(2129): n is a, c, g, or t
  misc_feature (2693)..(2693): n is a, c, g, or t
tggagagcctcatccttgaacgtgaaggacgtttgaagactgtggcatgatcacaggatgagatcacagggaacttgagtttctctcctcctctcccttcacagttatttcactgagggaaatccctcccctgcccagaatgaaaactctagccaactcttgacttttccatcactccaaagtagttgaaagtacattagtctccacagtggcaaaacagtgtgcaaaagctaaataattagaacagccagtcccatgtgacagtcaaagcttctaactccattcaaagttgcagccattcccctcaagggctggcagggaggggaggggtaagagaaacaggaaggttcttactgagtttggtcctggtgtgagctgcgtcacactccctgcagaggtttcaaggagactctctctctctctgtctccatggggaccttatttgaattcttctactcttaccccagcctgccatctccagctatcctcccctgaagagcccttctgctgcgctggattctggtggccatgtcatctcctcggccccgtgggagtctgaagatctggctgcagcctcacctctgaggtcctgctagttgccacctcttaaacatgatctgaggctcccatgcactctgacctgtgcccacatggggcccacgggaaacacgctggcaagcaaactgtgggtgtgcagacggttctcagggctgcagcacctgtcctttgctctgcccccaaagcaaggccagcccatcttccatcctctagtgttccttggtggggccctgaccacagtccaccaggtccctaaccagaggggacacacaccaggtgtcctcaatgtattgccttgaaacagttgtgctgggactgtgatggggggtggccatgtagccacccccaccacccccaagccactctctccaaggaaatcctcctaaagatccctttacatcctccatgtggtggggaggttctagagttgggtgcatgtgtcttcagctactgacaatgcagaccttagttggcacctcgctctggcctatcctgtttgctgttcttggcgctccagtgaaactccccatgggccatccagttggggtgcagtgtggccacccccttgcaggttcctgccttgctggagagcacagggccctcctggctcttgtaaaacactccccatggtacagagaggccagcagtgatgtgaggcccaacctccctccatggtgttcccaagcagctccctttctggggtcaaggggtggcaaagacagtgcagcgtccaatttctgactcaagccgggcctggctatcgcagctctgcactgtgtgtgacagcaaggcaactcacccagtgccgtggcagtgaccgtgtccgaggaagcctcctcacaccctctgtctcaaggactctggcatttagctggacttgctgtagctctgagcctttctgccattgccatcaccttgtcagaaactcaggccgaatctgcactcagagttgtgcccaggcagttgagccaacacttgctcagcgatattgtcacatgacaaggcactgtcaccactgggcntcgtgggtagcgcagtgtcggctggatggacccggagggtgtctgtgtcatgctagtgctagtgatgggagccccgtgagcccattgcccgccctcccatgccctcagcagctgcctggggacagccaatggcctgggtgtttctgaggctaccacatggcttccaggaaactcgagaacctttctctcccttgcctacactcttcacacaggcctgtgctggccagcggtggggatccggcattcctatcttaggtgcaganagtgactgactcattgcaggcctgggagataagactgatggcccagccagcaagatgtatggatttctcagaggcagtggcctctgtcattgtcctcaggaaatgctggtgattctggtggcctgaggtcaatgcatgtcaacgtggccaacttgccttataaactttttttctggacaattgcgtgcactgtcctgtaacagtgtcctgttgtttatgatgcagaaataggtgtttttaaagcctattgattttggtactattaatgtggtcaggaactttctcngtctttcttgtttggggtgagctgtggcttcctaaacaggaacccaagacacccccaaaagctgctcaccagcactgccagcctccctcttaccaagtagcacccgttcaggacattctgcgaaaggcatttgcccagaagttgggaggaaggaaatgtaacattttggggcacctaccatatgccaggcaccaggctaaacgtgttcacacaaattctcttactaaccctcaccatccttctacaagacaaactagtatcttcatcttggggttcaagatgaggaaatggaggctcagagaggttgaatgaatgccggtgcctggatatgaaccccatctgcctgactccgcaacccaggcaaagtctttccttgaacttcccagcagccactgcttagacacagcctccacaaccatggctcagcagcaaattgcttctctgacctcactcagcctgtgtgtccttgttgagtgaggcattcaggaccctggtcccaaagtggagaaagtctttcctactaggtcatagctacacctgcatgtgggtgctgtgccttttgtntagtgaacttttatcaccagcatcctcagcaatgacatttgcagagaagccagagctgaggcaccttggtattcttgggatgtgactttcctgaatgtttaagggaaaatgcccgaaggtacagagagcttggtttctagtaaacaataactgtcttgcttttaccccccttcatttgctgacacatacaccagctgaagaagcaggcattggagacacccccagcctggaagacgaagctgctggtcacgtgacccaagagcctgaaagtggtaaggtggtccaggaaggcttcctccgagagccaggccccccaggtctgagccaccagctcatgtccggcatgcctggggctcccctcctgcctgagggccccagagaggccacacgccaaccttcggggacaggacctgaggacacagagggcggccgccacgcccctgagctgctcaagcaccagcttctaggagacctgcaccaggaggggccgccgctgaagggggcagggggcaaagagaggccggggagcaaggaggaggtggatgaagaccgcgacgtcgatgagtcctccccccaagactcccctccctccaaggcctccccagcccaagatgggcggcctccccagacagccgccagagaagccaccagcatcccaggcttcccagcggagggtgccatccccctccctgtggatttcctctccaaagtttccacagagatcccagcctcagagcccgacgggcccagtgtagggcgggccaaagggcaggatgcccccctggagttcacgtttcacgtggaaatcacacccaacgtgcagaaggagcaggcgcactcggaggagcatttgggaagggctgcatttccaggggcccctggagaggggccagaggcccggggcccctctttgggagaggacacaaaagaggctgaccttccagagccctctgaaaagcagcctgctgctgctccgcgggggaagcccgtcagccgggtccctcaactcaaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcagataattaataagaagctggatcttagcaacgtccagtccaagtgtggctcaaaggataatatcaaacacgtcccgggaggcggcagtgtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagacgatgtcaaccttgtgtgagtgtgacgggggttggggtggggcgggaggccacgggggaggccgaggcaggggctgggcagaggggagaggaagcacaagaagtgggagtgggagaggaagccacgtgctggagagtagacatccccctccttgccgctgggagagccaaggcctatgccacctgcagcgtctgagcggccgcctgtccttggtggccgggggtgggggcctgctgtgggtcagtgtgccaccctctgcagggcagcctgtgggagaagggacagcgggtaaaaagagaaggcaagctggcaggagggtggcacttcgtggatgacctccttagaaaagactgaccttgatgtcttgagagcgctggcctcttcctccctccctgcagggtagggggcctgagttgaggggcttccctctctgctccacagaaaccctgttttattgagttctgaaggttggaactgctgccatgattttggccactttgcagacctgggactttagggctaaccagttctctttgtaaggacttgtgcctcttgggagacgtccacccgtttccaagcctgggccactggcatctctggagtgtgtgggggtctgggaggcaggtcccgagccccctgtccttcccacggccactgcagtcacccctgtctgcgccgctgtgctgttgtctgccgtgagagcccaatcactgcctatacccctcatcacacgtcacaatgtcccgaattcccagcctcaccaccccttctcagtaatgaccctggttggttgcaggaggtacctactccatactgagggtgaaattaagggaaggcaaagtccaggcacaagagtgggaccccagcctctcactctcagttccactcatccaactgggaccctcaccacgaatctcatgatctgattcggttccctgtctcctcctcccgtcacagatgtgagccagggcactgctcagctgtgaccctaggtgtttctgccttgttgacatggagagagccctttcccctgagaaggcctggccccttcctgtgctgagcccacagcagcaggctgggtgtcttggttgtcagtggtggcaccaggatggaagggcaaggcacccagggcaggcccacagtcccgctgtcccccacttgcaccctagcttgtagctgccaacctcccagacagcccagcccgctgctcagctccacatgcatagtatcagccctccacacccgacaaaggggaacacacccccttggaaatggttcttttcccccagtcccagctggaagccatgctgtctgttctgctggagcagctgaacatatacatagatgttgccctgccctccccatctgcaccctgttgagttgtagttggatttgtctgtttatgcttggattcaccagagtgactatgatagtgaaaagaaaaaaaaaaaaaaaaaaggacgcatgtatcttgaaatgcttgtaaagaggtttctaacccaccctcacgaggtgtctctcacccccacactgggactcgtgtggcctgtgtggtgccaccctgctggggcctcccaagttttgaaaggctttcctcagcacctgggacccaacagagaccagcttctagcagctaaggaggccgttcagctgtgacgaaggcctgaagcacaggattaggactgaagcgatgatgtccccttccctacttccccttggggctccctgtgtcagggcacagactaggtcttgtggctggtctggcttgcggcgcgaggatggttctctctggtcatagcccgaagtctcatggcagtcccaaaggaggcttacaactcctgcatcacaagaaaaaggaagccactgccagctggggggatctgcagctcccagaagctccgtgagcctcagccacccctcagactgggttcctctccaagctcgccctctggaggggcagcgcagctcccaccaagggccctgcgaccacagcagggattgggatgaattgcctgtcctggatctgctctagaggcccaagctgcctgcctgaggaaggatgacttgacaagtcaggagacactgttcccaaagccttgaccagagcacctcagcccgctgaccttgcacaaactccatctgctgccatgagaaaagggaagccgcctttgcaaaacattgctgcctaaagaaactcagcagcctcaggcccaattctgccacttctggtttgggtacagttaaaggcaaccctgagggacttggcagtagaaatccagggcctcccctggggctggcagcttcgtgtgcagctagagctttacctgaaaggaagtctctgggcccagaactctccaccaagagcctccctgccgttcgctgagtcccagcaattctcctaagttgaagggatctgagaaggagaaggaaatgtggggtagatttggtggtggttagagatatgcccccctcattactgccaacagtttcggctgcatttcttcacgcacctcggttcctcttcctgaagttcttgtgccctgctcttcagcaccatgggccttcttatacggaaggctctgggatctcccccttgtgggggcaggctcttggggccagcctaagatcatggtttagggtgatcagtgctggcagataaattgaaaaggcacgctggcttgtgatcttaaatgaggacaatccccccagggctgggcactcctcccctcccctcacttctcccacctgcagagccagtgtccttgggtgggctagataggatatactgtatgccggctccttcaagctgctgactcactttatcaatagttccatttaaattgacttcagtggtgagactgtatcctgtttgctattgcttgttgtgctatggggggaggggggaggaatgtgtaagatagttaacatgggcaaagggagatcttggggtgcagcacttaaactgcctcgtaacccttttcatgatttcaaccacatttgctagagggagggagcagccacggagttagaggcccttggggtttctcttttccactgacaggctttcccaggcagctggctagttcattccctccccagccaggtgcaggcgtaggaatatggacatctggttgctttggcctgctgccctctttcaggggtcctaagcccacaatcatgcctccctaagaccttggcatccttccctctaagccgttggcacctctgtgccacctctcacactggctccagacacacagcctgtgcttttggagctgagatcactcgcttcaccctcctcatctttgttctccaagtaaagccacgaggtcggggcgagggcagaggtgatcacctgcgtgtcccatctacagacctgcggcttcataaaacttctgatttctcttcagctttgaaaagggttaccctgggcactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360300 - DNA, 2037 bp, Homo sapiens
cccgccccctcccctggggaggctcgcgttcccgctgctcgcgcctgccgcccgccggcctcaggaacgcgccctcttcgccggcgcgcgccctcgcagtcaccgccacccaccagctccggcaccaacagcagcgccgctgccaccgcccaccttctgccgccgccaccacagccaccttctcctcctccgctgtcctctcccgtcctcgcctctgtcgactatcaggtgaactttgaaccaggatggctgagccccgccaggagttcgaagtgatggaagatcacgctgggacgtacgggttgggggacaggaaagatcaggggggctacaccatgcaccaagaccaagagggtgacacggacgctggcctgaaagctgaagaagcaggcattggagacacccccagcctggaagacgaagctgctggtcacgtgacccaagctcgcatggtcagtaaaagcaaagacgggactggaagcgatgacaaaaaagccaagggggctgatggtaaaacgaagatcgccacaccgcggggagcagcccctccaggccagaagggccaggccaacgccaccaggattccagcaaaaaccccgcccgctccaaagacaccacccagctctggtgaacctccaaaatcaggggatcgcagcggctacagcagccccggctccccaggcactcccggcagccgctcccgcaccccgtcccttccaaccccacccacccgggagcccaagaaggtggcagtggtccgtactccacccaagtcgccgtcttccgccaagagccgcctgcagacagcccccgtgcccatgccagacctgaagaatgtcaagtccaagatcggctccactgagaacctgaagcaccagccgggaggcgggaaggtgcaaatagtctacaaaccagttgacctgagcaaggtgacctccaagtgtggctcattaggcaacatccatcataaaccaggaggtggccaggtggaagtaaaatctgagaagcttgacttcaaggacagagtccagtcgaagattgggtccctggacaatatcacccacgtccctggcggaggaaataaaaagattgaaacccacaagctgaccttccgcgagaacgccaaagccaagacagaccacggggcggagatcgtgtacaagtcgccagtggtgtctggggacacgtctccacggcatctcagcaatgtctcctccaccggcagcatcgacatggtagactcgccccagctcgccacgctagctgacgaggtgtctgcctccctggccaagcagggtttgtgatcaggcccctggggcggtcaataattgtggagaggagagaatgagagagtgtggaaaaaaaaagaataatgacccggcccccgccctctgcccccagctgctcctcgcagttcggttaattggttaatcacttaacctgcttttgtcactcggctttggctcgggacttcaaaatcagtgatgggagtaagagcaaatttcatctttccaaattgatgggtgggctagtaataaaatatttaaaaaaaaacattcaaaaacatggccacatccaacatttcctcaggcaattccttttgattcttttttcttccccctccatgtagaagagggagaaggagaggctctgaaagctgcttctgggggatttcaagggactgggggtgccaaccacctctggccctgttgtgggggtgtcacagaggcagtggcagcaacaaaggatttgaaacttggtgtgttcgtggagccacaggcagactggcctagagcctcacctcctaatagacttagccccatgagtttgccatgttgagcaggactatttctggcacttgcaagtcccatgatttcttcggtaattctgagggtggggggagggacatgaaatcatcttagcttagctttctgtctgtgaatgtctatatagtgtattgtgtgttttaacaaatgatttacactgactgttgctgtaaaagtgaatttggaaataaagttattactctgattaaaa

SEQ ID NO: 360301 - DNA, 9080 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacgaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360302 - DNA, 1017 bp, Homo sapiens
tatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaattttgtctgtacaaaatgacattgtttttatttttagtaaaaagcttttacaaaggaagaggagttaattgaatgtacttcttcactctctctaaagcattcttgcatatacctccatatagctaagtgatcagggtcagttaatttttcagtcatttttgaaataaaatctaaaatgccctctgtgcaatatggaaaaggttcttgacaaggaaagtaaataacttaaagaatctgcttaagtggaatgcttctttctgtaggatccacattgggctcttgaaagagattctgataaaaccgtttaatgcattgttcacgagtctttttattttttttatgaagctttttgcatcgccatgatgaagcattctccacggagcccctcaaaaacaatggcagaggaagtcccctggccttttatcatgtgcagaattaagtgacatggacctttttgccaaacatatgtttttctggtaccttggctttctcagcccgggaagggtgataagaagaggtacaagtcactggctgtgcagggggagagtagacaatagagggcgtggctagagtggtgaggtcatccacagcggcctgagcagcaagccttcttgtctgtgttacagtgggcctagtgaatgtgggttcgtcttgccaataaaatcttccatcagtttgaatgccaatgagttgttttagtgtttctgtcctagaaaaataagcatgcttaataagagttttattaaagtgaatgcattgtccttt

SEQ ID NO: 360303 - DNA, 941 bp, Homo sapiens
tatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaattttgtctgtacaaaatgacattgtttttatttttagtaaaaagcttttacaaaggaagaggagttaattgaatgtacttcttcactctctctaaagcattcttgcatatacctccatatagctaagtgatcagggtcagttaatttttcagtcatttttgaaataaaatctaaaatgccctctgtgcaatatggaaaaggttcttgacaaggaaagtaaataacttaaagaatctgcttaagtggaatgcttctttctgtaggatccacattgggctcttgaaagagattctgataaaaccgtttaatgcattgttcacgagtctttttattttttttatgaagctttttgcatcgccatgatgaagcattctccacggagcccctcaaataagtgacatggacctttttgccaaacatatgtttttctggtaccttggctttctcagcccgggaagggtgataagaagaggtacaagtcactggctgtgcagggggagagtagacaatagagggcgtggctagagtggtgaggtcatccacagcggcctgagcagcaagccttcttgtctgtgttacagtgggcccattcgactgggctctcgctggccacaaccacctccatcacctcgaacgccccccatcgttcacgcgtcctccctctactccctatctccccctacaccccg

SEQ ID NO: 360304 - DNA, 887 bp, Homo sapiens
tatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaattttgtctgtacaaaatgacattgtttttatttttagtaaaaagcttttacaaaggaagaggagttaattgaatgtacttcttcactctctctaaagcattcttgcatatacctccatatagctaagtgatcagggtcagttaatttttcagtcatttttgaaataaaatctaaaatgccctctgtgcaatatggaaaaggttcttgacaaggaaagtaaataacttaaagaatctgcttaagtggaatgcttctttctgtaggatccacattgggctcttgaaagagattctgataaaaccgtttaatgcattgttcacgagtctttttattttttttatgaagctttttgcatcgccatgatgaagcattctccacggagcccctcaaaaacaatggcagaggaagtcccctggccttttatcatgtgcagaattaagtgacatggacctttttgccaaacatatgtttttctggtaccttggctttctcagcccgggaagggtgataagaagaggtacaagtcactggctgtgcagggggagagtagacaatagagggcgtggctagagtggtgaggtcatccacagcggctcggccttcataatttgatgcatgagtggtaagggttcgcc

SEQ ID NO: 360305 - DNA, 10269 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacagagtgtaaccttgtccccaccgtgcctcccctcaagaagattttcgtatgtgcaaaaacactgccaggctaggaaaacaaagtccttaaatagcttaatttgaagttagggttattccctatgactgctaacaggtggccatatttttcagtagaaagttagtcacaagatatttgttgagcacattcgacctctttcccattgggtatgattgtatcgtctcatctctgaagcttgcttgctgaaaaccatttgtcaatggtttattctttctattcaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacac

SEQ ID NO: 360306 - DNA, 6957 bp, Homo sapiens
ttatgtacattatgttagtggatcttcatgattgcttttcaagatagtaggctaaatattagggtctacagtttataaatgaggagacagactcccagaggttaagcagcttaactaaagtcacatagcatcagtacagttaagaatatggagtttaaatctggccggttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360307 - DNA, 7256 bp, Homo sapiens
agactctagagtaccccacgggtgaggtagagctaaaatatctttgataatgaagtactgttacagtcatgagtgacttttcgtctgttgcaatgactcgttctggtctgtccttggaggagttgaggattgtggaaggacagggtcagagttctgaggtcatcactcctccagaagaaatcagtcgaattaatgacttggctttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360308 - DNA, 11039 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtatccaggggcagggttgttcagatgcaagaactctcggacaagattgccaaagtatcagtcttcctccccgctgctgcatgtgatcatagcttttcacttttctctcctgaggtcttaacgagctttgtgtttgctatagcagtagtattgatcttctcaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360309 - DNA, 4872 bp, Homo sapiens
gtgggaaccgcacccaccacacatgcatgaaataaatcgcagtccaaatgggaagctcacacacacacatgcacaagataatcacagtccaaatgggaagcgtgtgcatacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360310 - DNA, 4122 bp, Homo sapiens
ttatgtacattatgttagtggatcttcatgattgcttttcaagatagtaggctaaatattagggtctacagtttataaatgaggagacagactcccagaggttaagcagcttaactaaagtcacatagcatcagtacagttaagaatatggagtttaaatctggccgggtatggtggctcgcacctgtaatcccagcatttgggaggctgagtcggacagattgcttgagctcaggagttagagaccagcctgggcaacatggcgaaaccctgtctctacaaaaaaatgcaaaaattagccgggcgcggtggtgcacgcctttggtctcagctactcaggaagctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360311 - DNA, 6075 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaa

SEQ ID NO: 360312 - DNA, 1962 bp, Homo sapiens
agcagagaggcgggtgaatcggacgaggcgagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360313 - DNA, 1223 bp, Homo sapiens
gtgggttgaccgtggctgtgggttgaccgtagcttgtgggttgaccgtgggttgaccgtggctttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaa

SEQ ID NO: 360314 - DNA, 4690 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcagatcacgaggtcaggagatcgagaccatcctggctaacacggtgaaaccccgtctctactaaaaatacaaaaaaattagccaggcgtggtggtgggcgcctgtagtcccaactgctcgggaggctgaggcaggagaatggcatgaacctggaggcggagcttgcagtgagccacgattgtgccactgcactccagcctgggcaacagagcaatactccatctcaaaaaaatatataaataaataaataagatattttgcacatggaaacatctgtggtcttggctactcaggaggctgaggtgggaggatcgcttgagcttgtggaggtgaggttgcagtgagctgagatggcaccactgcatcaagcattgacgacagagtgggcgagactctgtctcgaaaaaaaaatacataaacatatt

SEQ ID NO: 360315 - DNA, 3188 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagggcatttgtttacctgagcaatctgctgtatcccgtgcccctgatccacagggtggccatcgtcagtgagaaaggtgaagtgttgggcgataacatcacgagatcctcgagatc

SEQ ID NO: 360316 - DNA, 2089 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaaggtaggaaacaatgctgtgaaacctaatcagacagagacactttttgtttgtctttgttactggggcacttcatgtctttcaggacctactctcccccttattatcttgatacttgccttaatttcagatatttctgatttcatcttagagcatggtcttatagtacaaaggcagcctatttctaaaatgcctatcttgtttactgtttacaaaagaaaaa

SEQ ID NO: 360317 - DNA, 962 bp, Homo sapiens
  misc_feature (962)..(962): n is a, c, g, or t
ttatgtacattatgttagtggatcttcatgattgcttttcaagatagtaggctaaatattagggtctacagtttataaatgaggagacagactcccagaggttaagcagcttaactaaagtcacatagcatcagtacagttaagaatatggagtttaaatctggccgggtatggtggctcgcacctgtaatcccagcatttgggaggctgagtcggacagattgcttgagctcaggagttagagaccagcctgggcaacatggcgaaaccctgtctctacaaaaaaatgcaaaaattagccgggcgcggtggtgcacgcctttggtctcagctactcaggaagctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaacatccttactcccttgttagacctttn

SEQ ID NO: 360318 - DNA, 438 bp, Homo sapiens
tgcctcagcctcctgagtagctgggattacaggtgcccgccaccacgcccggctaatttttgtatttttagtagagacggggtttcaccatgttggtcaggctggtctcgaactcctgacctcgtgatctgcccacctcagcccctcaaagtgctgggatgacaggcgtgagccaccgcacccggcctgaaaccgattctttattgactagtctcatttgagctgaggaagttgataaatctacatgaatagagtgcgaagcagcccatgccgtgttactactttggtatcattctctcatgccaaagacttgagtttataatccagcaagagctttttccctccctccccctgtgtagtctcactcaattcttgctaatttttttttctgctttagcggatgaagaagctcctgattatggctctggaattcgacag

SEQ ID NO: 360319 - DNA, 5546 bp, Homo sapiens
  misc_feature (273)..(273): n is a, c, g, or t
agcaaacaaactcttctagagatatttttggtaaccacagtgaataaaagattgactgttagtaactattttcatttactagactgccctgaactactcatctgtgagttgagtattttttttttaagtgaaagcatgtttattaagaaaataaaggaataggctgggtgcggtggctcacccctgtaatcccagcactttgggaggccaaggtgggtggatcacctgaagtcaggagttcaagaccagccgggccaacatggtgaaaccccntctctaccaaaaatgcaaaaattaggtaggcgtggtggcaggtgcctgtagtcccagctactcgggaggctgaggcaggagaattacttgaacccaagaggtggaggttgcagtgagccgagatcgggcactccagcctgggcgacagagcaagattctgtctcaaaaaaaaaagaaacaaagaaagaaagtaaagcaataaagaatggctacttcataggcagagcagctgagtattttcttttcccagcaacttttatctcccgaatagaaattctttctaatcccacttactatttggaattctaaatccaacattgctttcccagagatccatgttatcaagatttgcttgtattagttaagagcgattgcttattatctatacagcccttgaaattacattgttgtgaagtcaggctgctgttttagggctaagtaaggttttctgaaaaagaggcaatggtgcaaagacagctggaaagacagagttaaacataccttttaaagtggatcaattttatgtaaccagagtatgatctttctgttttatgtgtttattggaagagttgtcacttaaagtgatattcctcaaatagctaaaaatgtcctgggttttctagatagaaaatatctctaagttgtacttattaaaatgtgacttggggaattttaaattatattcagtggaagtatatttgcccagctttatttttgttcgggtaatttatttctcaaaattttggaggtgaggtctttattgatttgtgtgtgtgaaaaacaagacaaaacacacccactatgaggatcctttaaaaaaaaagctttcttgttatccagataacacactttaatcgtacgacggaaatggatacatttaacatgacaaaaaatagcaaatcctctgctcatggaaagatgatttccaaaccctcttgtcttacagaagaaaacatttggttgactaagaactgacatggtctgctcatagggattcttagcatttttaacatcatccctgtttgactgcttctttttctacattctcatcttctaacttttttctagggctgctctttttagtaaagctaaacaaaacctggcgtcctacagccttactaacctttgttaatccgcctgctcgtcacatctttgtatggcatctgtgctcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagaaagtggaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaa

SEQ ID NO: 360320 - DNA, 10756 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360321 - DNA, 10703 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360322 - DNA, 10876 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360323 - DNA, 9358 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcagctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360324 - DNA, 7899 bp, Homo sapiens
gagctcttgaatgggctcctccgccaacctgcccgagcagcattcatagagcagtatcttgaaagtctgcttccaggtgtgactcttctccctacagtagttaagttttagagcatgatttggtgtgtgttggtcttcgtcaacagttctgccaagcgtttgcttgttcattatctgtgctgaaaaggcagctggaggcaaatctgagaggctaggactgagaaggggtcttaagacaaggccagaagtcagctcacagttgcaggaagatgttctcagtgaatctgaaagccagtttatctctccatggatgttctgacatttgtctcctggtttctgtctttagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360325 - DNA, 7652 bp, Homo sapiens
tatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaattttgtctgtacaaaatgacattgtttttatttttagtaaaaagcttttacaaaggaagaggagttaattgaatgtacttcttcactctctctaaagcattcttgcatatacctccatatagctaagtgatcagggtcagttaatttttcagtcatttttgaaataaaatctaaaatgccctctgtgcaatatggaaaaggttcttgacaaggaaagtaaataacttaaagaatctgcttaagtggaatgcttctttctgtaggatccacattgggctcttgaaagagattctgataaaaccgtttaatgcattgttcacgagtctttttattttttttatgaagctttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctcatttctctttgtgattcttgacggtgactcttgtatgtaatcctgtggcttaactacttctccctccttgtccagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtggcaggctttgctttctggatcccaggattaaaactaaccgtgaccactactccaaacaaaacacaatatgcctaggggcacggatgaacgtccagggagcccgggccccaggctttgttgcgtgttccctgctcctctccatctggtgtggaaacactgcccagggagaaaggaggaagctcactgtggacagtcttctttccttctgacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcgtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctgaataagaaggcctcttagggagccagagggagcagagtggtcgtgtcctgcgtgctcttcaccctctggggcgcccctgctgcggctggcaggtgcagacagcctttgctggtccccagcacgtccagggtgggtgctcccttgcccgacagaaccatccccactgtgaggctgtgagagatttgtggcaggaactgtttatgaggctctagttgttgctgttgtggcgggaaagttaagaaacatagcccttaaggaaaccacctttatgtattttcttaaagcacgcctttaaataagcaaaaactttaaaaggcaggaaagagaattcttaggcaaattcagagaaataagtgctagttaatactaatcacctcctcctctgtctctcatcctcctttctcccatcaaagcaaaatatggcctcaccaccagccccaaatcagtgctcagaccctctctgtgtctgtgtgccctcctgggagtcagtcagcgctcaggccaggactgtgcagggccagccagcccatgcgctagtcaggagcacaggcaaggggtgcttgtggcagtggccgggcacctgagccccagctcgttgttaaacgtgctgacggcaaggggcaatggagtgagtttcccaactaagaaaccactattatatattttttcccttcagtcacatagacttcagacaactctcctattttttatggatttttcagctcatttcagatgaaggaactaagtcattgtgaactgtctcttgagatctaaaaacaagatgacttttcctggcacatattccaaagcaaagactttgttgcctgctgcttattgtctaatttacagggatatttaattttgtcaggtctatgtatatttatccagctatacttacttgcacagtggattggagagaaaggattctccagtgtgcacactcatcggtactctttctgcatttccctcgtgctgtgtcccgctcgggttccaatggacagtatcagggcttgtttgacttaggtctttcagttttcctttcggttcccttttaaaaatgtgattgttaacctgcctcttgaaagattcaaccgggtgtggtggctcacgcctgtaatcccagcacattgggaggccaaggcaggtggatcacctgaggtcagaagtttgagaccagcctggccaacatggtgaaaccccgtctctactaaaaatacaaaaagtagccaggcgtggtggcgtgtgcctgtagtcccagctacttgggaggctgaggcaggagaatagcttgaacctgggaggtggaggctgcagtgagttgagactgcaccattgcactccagcctgggtgacaaagcaggactccgtctcaaaaaaaaagaaaagattcatgatgctgctgctcccagaaggtttgctggatgtgtttacataggactctaacttgtgtgcactacagttgttcaccagggccagtgattcaccccagtgtgtggccagaccatgactgtgtagcaggaatgttttaatttgtgcttccttagtaaattgaaatatcagctgagagattatttgctgctgttattcaaaaggccatttatgaagttagtatttgagccccataagatctttaaaaagcctccaatcatttaaaggaagaaatcagagttgctataaaattcagtaaaaagctcatagccaaacggctgtgctcagatggaaagtctgagctgaggttggtctcttgccaaaccgtggctgttgtgtgttgttcttcatgtcttcgagttcattttttttcattctgcctattctggcatcagctcacttgaggagtccctcagccttcttgtatttaaggcatcgtcttagactttgtggctctaaagtacctgtctgttgagatttcaagtctcttgtcaccatcctcacacatgacaacaaaacccataatgcataagtggcctttttgaaccaagactttgcaaactgatctctcccccgtgaaggagttgagcacattagcaacaatgtacattaattttggattttcattttcatgttttattttgtaaatattatctgatgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcagaaaaaaacga

SEQ ID NO: 360326 - DNA, 6000 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtctttaaaaaaaaaaa

SEQ ID NO: 360327 - DNA, 5907 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctcctgattatggctctggaattcgacagtcaggaacagctaaaatatcttttgataatgaatactttaatcagagtgacttttcgtctgttgcaatgactcgttctggtctgtccttggaggagttgaggattgtggaaggacagggtcagagttctgaggtcatcactcctccagaagaaatcagtcgaattaatgacttggatttgaagtcaagcactttgctggatggtaagatggtaatggaagggttttctgaagagattggcaaccacctgaaactgggcagtgccttcactttccgagtaacagtgttgcaggccagtggaatcctcccagagtatgcagatatcttctgtcagttcaactttttgcatcgccatgatgaagcattctccacggagcccctcaaaaacaatggcagaggaagtcccctggccttttatcatgtgcagaatattgcagtggagatcactgaatcatttgtggattacatcaaaaccaagcctattgtatttgaagtctttgggcattatcagcagcacccacttcatctgcaaggacaggagcttaacagtccgcctcagccgtgccgccgattcttccctccacccatgccactgtccaagccagttccagccaccaagttaaacacgatgagcaaaaccagccttggccagagcatgagcaagtatgacctcctggtttggtttgagatcagtgaactggagcctacaggagagtatatcccagctgtggttgaccacacagcaggcttgccttgccaggggacatttttgcttcatcagggcatccagcgaaggatcacagtgaccattatccatgagaaggggagcgagctccattggaaagatgttcgtgaactggtggtaggtcgtattcggaataagcctgaggtggatgaagctgcagttgatgccatcctctccctaaatattatttctgccaagtacctgaagtcttcccacaactctagcaggaccttctaccgctttgaggctgtgtgggatagctctctgcataactcccttcttctgaaccgagtgacaccctatggagaaaagatctacatgaccttgtcggcctacctagagctggatcattgcatccagccggctgtcatcaccaaggatgtgtgcatggtcttctactcccgagatgccaagatctcaccaccacgctctctgcgtagcctctttggcagcggctactcaaagtcaccagattcgaatcgagtcactggcatttacgaactcagcttatgcaaaatgtcagacacaggtagtccaggtatgcagagaaggagaagaaaaatcttagatacgtcagtggcatatgtgcggggagaagagaacttagcaggctggcggccccgtggagacagcctcatccttgagcaccagtgggagctggagaagctggagctcctacatgaggtggaaaaaacccgccactttttgctgctgcgtgagagacttggtgacagcatccccaaatccctgagcgactcgttatcccccagcctcagcagtgggaccctcagcacctccaccagtatctcctctcagatctcaaccactacctttgaaagcgccatcacacctagcgagagcagtggctatgattcaggagacatcgaaagcctggtggaccgagagaaagagctggctaccaagtgcctgcaacttctcacccacactttcaacagagaattcagccaggtgcacggcagcgtcagtgactgtaagttgtctgatatctctccaattggacgggatccctctgagtccagtttcagcagtgccaccctcactccctcctccacctgtccctctctggtagactctaggagcaactctctggatcagaagaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaagacaccaaacacctttgctgtctgcacaaagcaccgtggggtccttttgcaggccctcaatgacaaagacatgaacgactggttgtatgccttcaacccacttctagctggcacaatacggtcaaagctttcccgcagatgcccgagccagtcgaaatactaagtgactctgccgagtgccctcactcgccttcgagagataaagaaagcgttacctctc

SEQ ID NO: 360328 - DNA, 3784 bp, Homo sapiens
gcggagtttcgcgagggccgaagcggggcagtgtgacggcagcggtcctgggaggcgcccgcgcgcgtcggagcagctccccgtcctccgcagccgtcaccgccggccgtcgccgcgccctggcctcccgcactcgcgcactcctgtccgccgcccaccgcccacctcccacctcgatgcggtgccgggctgctgcgtgatggggctgcggagcggcgccctgcggctcgcggcggccgctgctcgcgctgaggtgcgtcggtgcccggccccccgcgcccccgcgcgccgcggctcctgttgacccggtccgcccgtcggtctgcagcgcggctgaggaaacttggctgtaacttcaaaagaagatttgattctttatttctggactgcatatatatatataacaaggccattaaaatgtcgggagcctcagtgaaggtggctgtccgggtaaggcccttcaattctcgagagaccagcaaggaatccaaatgcatcattcagatgcaaggcaactcgaccagtattattaacccaaagaatccaaaggaagctccaaagtccttcagcttcgactattcctactggtctcatacctcacccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacagttatgtgaagaactttttgagaaaatcaatgacaactgtaatgaagaaatgtcttactctgtagaggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggacagtggcagctacaaacatgaatgaaacaagtagccgttcccacgctgtgtttacgattgttttcacccagaagaaacacgataatgagaccaacctttccactgagaaggtcagtaaaatcagcttggtggatctagcaggaagtgaacgagctgattcaactggtgccaaagggactcgattaaaggaaggagcaaatattaataagtctcttacaactttgggcaaagtcatttcagccttggccgaggtgagtaaaaagaagaagaaaacagattttattccctacagggattctgtacttacttggctccttcgagaaaatttaggtggcaattctcggactgcaatggttgctgctctgagccccgcggatatcaactacgatgagactttgagcactctgagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatattgatccattgatcgatgattactctggaagtggaagcaaatatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggaatcagagaagatcattgctgagttgaatgaaacttgggaagagaagcttcgtaaaacagaggccatcagaatggagagagaggctttgttggctgagatgggagttgccattcgggaagatggaggaaccctaggggttttctcacctaaaaagaccccacatcttgttaacctcaatgaagacccactaatgtctgagtgcctactttattacatcaaagatggaattacaagggttggccaagcagatgctgagcggcgccaggacatagtgctgagcggggctcacattaaagaagagcattgtatcttccggagtgagagaagcaacagcggggaagttatcgtgaccttagagccctgtgagcgctcagaaacctacgtaaatggcaagagggtgtcccagcctgttcagctgcgctcaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggctacaggaaatggagatcttatacaaaaaggagaaggaagaagcagatcttcttttggagcagcagagactggactatgagagtaaattgcaggccttgcagaagcaggttgaaacccgatctctggctgcagaaacaactgaagaggaggaagaagaggaagaagttccttggacacagcatgaatttgagttggcccaatgggccttccggaaatggaagtctcatcagtttacttcattacgggacttactctggggcaatgccgtgtacctaaaggaggccaatgccatcagtgtggaactgaaaaagaaggtgcagtttcagtttgttctgctgactgacacactgtactcccctttgcctcctgaattacttcccactgagatggaaaaaactcatgaggacaggcctttccctcgcacagtggtagcagtagaagtccaggatttgaagaatggagcaacacactattggtctttggagaaactcaagcagaggctggatttgatgcgagagatgtatgatagggcaggggagatggcctccagtgcccaagacgaaagcgaaaccactgtgactggcagcgatcccttctatgatcggttccactggttcaaacttgtggggagctcccccattttccacggctgtgtgaacgagcgccttgccgaccgcacaccctcccccactttttccacggccgattccgacatcactgagctggctgacgagcagcaagatgagatggaggattttgatgatgaggcattcgtggatgacgccggctctgacgcagggacggaggagggatcagatctcttcagtgacgggcatgacccgttttacgaccgatccccttggttcattttagtgggaagggcatttgtttacctgagcaatctgctgtatcccgtgcccctgatccacagggtggccatcgtcagtgagaaaggtgaagtgcggggatttctgcgtgtggctgtacaggccatcgcagcggatgaagaagctccttcccgtgggttcttggtctcactgacttcaagaatgaagccgtggacccttgcggtgagttgttacagttcttaaatatggtgtgtacggagtgagtcccttcagatgttccgagtttcttccttctggtgggtacgtggtcttgctgacttcaggagtgaagctgcagacttacacagtgagtgtaacagctcttaagggtggcacgcaggttgttcggccctcccggtgggttcatggtctcgctgacttcaggaatgaagccgcagaccttcgcggggagtgttacagctcataaaggtagtgcgggacccatagagtggtg

SEQ ID NO: 360329 - DNA, 280 bp, Homo sapiens
agaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaaggtccgtcctgccctgccttggtttcttattgccacgtgtgcccttctcttttgatttctgcactctctgttacgtggtgtgaaatttccctattctctctg

SEQ ID NO: 360330 - DNA, 150 bp, Homo sapiens
aatttattaagcacatgcagtagatggttttccatcctatagttaatgtgtctcagattcatggcagagaaccatgggtccttggactgtcagagaagggtggggacagtttctctcttcttatgaatgaatgaacaagtgcttgggtct

SEQ ID NO: 360331 - DNA, 1813 bp, Homo sapiens
  misc_feature (1)..(3): n is a, c, g, or t
nnntctttaaatcttattttagtagctaatgcatgtttgaaataagatgtgttagaaattatatgactatattaaggttgtgtttatattaggtgaaaaattgcatgcaattggtgaatcatgcagctttggggacatttacactgccactcacacacaggctctgtctcaatccgtatgcatgattcacgtcctttcaaaagtcccttttcaacatttggtaaagtgaaaatgttattcatagtgctaatgagccaataaacaatgctgcgtttcttttttctaactgcagcatattgtggtaaattttctcccaaaactttatttttggagttattgttggcaataaatacaacaaattatttgttggcaagtgatacaatttactgtataacaacttaatagtacaaagcatgaagatgtgaaaatatcatcttaaccagtttcattctatgaacataatattctggcagctttttctataactgagaatggtatatctttttatacactgcctaaatcagtactactgccagtcacctgaggtcaggtctgcacaacactaaattgggcaataacatagaacatctaggcagtcttgacagtcaaccagtgtaatcactaggggaagaaaaagtaggcctacccttttacttattaacttaagtaataaaaattgtataaaaatatgaatgttggctgcagaggagcctttacatgcagataatttgaagcagtctttgaaaataacaaaaattattccatttaatgaagggtttgttttgtttagcttttctcttttattcagaaaacatacctgtgcttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatattgtatgtgtgtgacattcagctaacattgatctaggcacttagtttgctaccacattgttcccttcattgattgaaactgtaaataacataacactttaaggcagctaagcaaatattttaataagccatgaaaggcaagatgccagagaaaatctgtatattcagctatttggagaactcgtgttttccacaaattaaactggagatgtcatttgaaattttcttcccttaaacatgctgtcacaacatggattccttctcatggatgtctttctaggcttataaatatatggtgtgattgctataattttgtgaaattttattcagcaattaatagtgatttcagcaatatgtactaagattccaaggcagaaataaatgtataaaggatttgagcctgtatgtgtaagaagaaactctctcttcagtcatatttcctaaattcagtgtaagtacctcgctgatttagcactggagttattccttgaatgtgtaaataatgatgttctattctgacctaatgaattcctgtaatgtgaatatttaaaataaaagaattcaatttaaatgtatac

SEQ ID NO: 360332 - DNA, 1783 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgcaaatctttgacggggttttccttgtcctgccaggattaaaagccatgagtttcttgtca

SEQ ID NO: 360333 - DNA, 743 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccctatacggaacacaacttaacactggcgacagtc

SEQ ID NO: 360334 - DNA, 1702 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgcaaatctttgacggggttttccttgtcctgccaggattaaaagccatgagtttcttgtca

SEQ ID NO: 360335 - DNA, 1866 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgcaaatctttgacggggttttccttgtcctgccaggattaaaagccatgagtttcttgtca

SEQ ID NO: 360336 - DNA, 1115 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaagagtatgtactacacttgacgctacactgcgcggatgtgagctaccaatgtgataccttatcaccacacatcgaacaatagtacaaaatgtcaaccaatttactcatggaatcccagaaacttcgccctatccccatttccgcaacaccttctcccccaacagaaaacaccccataactacctcacacacagtactatacaaccatccgccaacaccaacattactgacaccactctccattccctacatcacccaacgcaatgtcacacgactttcacacacctcgctatactcac

SEQ ID NO: 360337 - DNA, 507 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctccaccgccatgtagctcaggtagacaacctgctgctggaggtcctgcatgaatccaaagctgagggtccatagggga

SEQ ID NO: 360338 - DNA, 1438 bp, Homo sapiens
cgcaagatatgtatgaggtacagagcgcgggtgtaagtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgcaaatctttgacggggttttccttgtcctgccaggattaaaagccatgagtttcttgtca

SEQ ID NO: 360339 - DNA, 1776 bp, Homo sapiens
attccacgtacactgttggcctactggatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgcaaatctttgacggggttttccttgtcctgccaggattaaaagccatgagtttcttgtca

SEQ ID NO: 360340 - DNA, 616 bp, Homo sapiens
ccaaatttcaatagtgggacaggcatagaatagactttcccattacaaaatggagaagttgggaggaagagaggagtaacatgtccaaatcaagttcaaaacctagcaaacaaatgccattagatcttgaggctcaagaataattctttttagtttgatgctctgtctttgagacccatgtcctgcaaggcttttttgggtgggggttgtgccctcaaagctctgcaatgtgagagtcacatccacccccaaggctcagctgagtgaattctcattctccaggctccaggctgccactgtctagcctgttgaaaccaaggcaatggctctctcccccattgaaaaccaaggagacagacctgatgacctctgaattgccctcaggattactgcttttcttatcttcaagagtagtacacatctgcagctaaatagcttgatgttctggtactgtgggctgtaagaagtcctgtagcttctttctattgaaactgtttccattgtctttagctctgtcaatctgaaataatcaaaagaatcagaattcagtcttgaagaatttattctagcaaaaagtttggaatgatcattagagaaacattggctccagaaaatg

SEQ ID NO: 360341 - DNA, 325 bp, Homo sapiens
aacatttaaaaatttattatactctgagctagtcctgaagaataagaacgagaccatcactactttaggtattttttttctcaaaacatattaaaatatgacttgttgaaggataatatattttagttaaacaattgccccttaattcacagactgtaattatatatatttttacctgctgaatgcattttgtttttagtctgatgttttagaattctttttgaaatgctgaagctctttcggctgtttctcaggcattccaagtctttctgtgtctttggttgccatccagtggcagcagccatatacttcagttgagtaacag

SEQ ID NO: 360342 - DNA, 346 bp, Homo sapiens
gagctcatagtctagtgagagaaatgctaatccagtgatttcttaaatgaacagaagagcttgagtattaagtgctaagaaggagatgaaggtacgcaatgctgtgagtgcctgtgataaatctgagccttctcagggttaggctgtgcctattgagatttggaggcacggtgagtattgactgggggcattatcatcccatgtatcaccttctcagtgtcctttaatggctgagactctttcccctgcttccttaatgtaacatactccaagctcatttctggtccttgtaaatccattttgttattctacatttcttgaggtcttatccactaatctcacaagg

SEQ ID NO: 360343 - DNA, 529 bp, Homo sapiens
ggagacagagtcttgggagtcttgctctgtcacccaggatggagtgcagtggcacgatcttggctcactgcaacctccgcttcccaggttcaagcaattctcctgcctcagcctccccagtagctgggattacaggcgcacgccaccatgcctggctaatttttgcatttttagtagagatggggtttcaccatgttggccaggctggtctggaactcctgaccacaatgatccacctaccttggcctcccaaagtactgggattacaggcgtgagccaccgcactcagctggttttctaaacttttagatttctcttcttcttcaaatgccacaggtgtttgagttttttttgtgatttttgtttttttaagctcatcagctattgttagtgttagtgcattttatgtgtggcccaagacaattcgttttccaatatggcccagggaaatccaaatgattgtatacccctgcaaaccaatggtggagattctcttggagtagagcaaaaagattaagggtaatgactc

SEQ ID NO: 360344 - DNA, 673 bp, Homo sapiens
agcgggtcgtctaaagcaacttccgtgggtgccaggttgtgggctgggggcggtgctgaccttgagagagcggaggaggcgcaggcgcagcacagtttaaacttgattttgtgaggggacgaacagcgtgacaattaaaagaagatctgggaatcatccaatgtgataatttatgtgaaatctttctgcaaactatacagtatgataaaaatataaggtagtttcactggaaacaacagaagactagaagctgatgtgacgtggcaatatcaaccaggaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgttcctcagacatgttatttgtctttacaaagattggtttcaataaactgtgtgactgatattaaataaacatggaattttacacattc

SEQ ID NO: 360345 - DNA, 1043 bp, Homo sapiens
gggatcgtggtggctgcgcttgcgaggaccctgaggtagattgggtggtttcaacaggaacgcatccactgtctgagagtttaaacttgattttgtgaggggacgaacagcgtgacaattaaaagaagatctgggaatcatccaatgtgataatttatgtgaaatctttctgcaaactatacagtatgataaaaatataaggtagtttcactggaaacaacagaagactagaagctgatgtgacgtggcaatatcaaccaggaatacccatctcgagttctggatatgtgctctgagaaggtgcccatgtcaccgaccacactggaggccaatgcagatactgggggaaggttccatggtagctaagtgtggacaagctaatcactgaagttccctgatgcagagttgataatctctctagagttggatgaaagactgtgctgccttgaagctctgagagatgccatgccaattcaaggcagggtctttattgttgaaactcttgcgtaatgacatctttattcaggtgaaaatacaggatgaatttcaactatatgatattgtttatgttcctcagacatgttatttgtctttacaaagattggtttcaataaactgtgtgactgatattaaataaacatggaattttacacattcataatatttggtttcttgtgattttgatgaactatactttcaagcattgtcagttcatcctcatttacaaggaaacatttgctgtagcagagtgatgtagtgacttgctttacttaagataagccaacttttctattcaatgtttaatgtgaaactgacttaaaaattttcttttaggccacatttacatttctgtttgtataacatgcattatactattttaacttaatactatggctatataaactaaagacatcctacttctgtttttaatttattgttttgcaagataaataatctttaatgccctaatgaagctaaggagttcatattaaaagacatgttatatgacctactgaagttgagctatggaaattgactatctt

SEQ ID NO: 360346 - DNA, 697 bp, Homo sapiens
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaattt

SEQ ID NO: 360347 - DNA, 983 bp, Homo sapiens
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattgtaagcactgctatttgtacattcccaccacctgtcagttggcaaaaagctctgggaagctgcttttgcttcccagtcatgagatgaaactgtgaatgtgcataaggtccatgccctgacccagcgtccaagatcctgagtgcacaggcagattgccacatgatgatgtaaagtggcaatatcgaggcaccaaatgctcccatcatgactggagacgtttaaagttatatcctgatatttttggtgtaagaatccctttcttcatattacacaagggaaggtcaaaggacataggacatctaactctccttttttga

SEQ ID NO: 360348 - DNA, 701 bp, Homo sapiens
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcaggagccttcacgtaaatgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaac

SEQ ID NO: 360349 - DNA, 432 bp, Homo sapiens
tgcatgaacagctcaggtgggttcagagtggctcagctatgaggggctgcctagttactgagaagcttattatggagctcagagaagtagtcagggctgactcttagaaatggcagctctcctgtttacctgtaatcatttcagttggaattacaaagcaggtcagctgaaaagagtcagcctgtgaagcattgtatttaacttggattcacctggaaagatagaagtggattctgtgatgtcttcaataaatccaaatacttctggtttattgcagtttctaagttgagctcactgtgatagccagatgctagactccttcattttcaagaggatttctctgtgtgcactgaccctgaagcttagaactgtgaaccacaaaaaactatacttaatggaactttcaagtaaaaaatttatatagttttgtta

SEQ ID NO: 360350 - DNA, 2660 bp, Homo sapiens
  misc_feature (1231)..(1231): n is a, c, g, or t
  misc_feature (1635)..(1635): n is a, c, g, or t
  misc_feature (1749)..(1749): n is a, c, g, or t
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcntgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacangagcaagccctctcgggctatatacagaggaagaacagggtgatgagggtactgggggcaagagacatgtttgcagaaccctttaggatggtctaggcttgggagtctcactgnggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcgctttgtcacctaagctggagtgcagtgcgcgatctcggctcactgcaacttccgcctcgctgaggcaggagaatagcatggacctgggaggcggagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaa

SEQ ID NO: 360351 - DNA, 2618 bp, Homo sapiens
  misc_feature (1189)..(1189): n is a, c, g, or t
  misc_feature (1593)..(1593): n is a, c, g, or t
  misc_feature (1707)..(1707): n is a, c, g, or t
tgcatgaacagctcaggtgggttcagagtggctcagctatgaggggctgcctagttactgagaagcttattatggagctcagagaagtagtcagggctgactcttagaaatggcagctctcctgtttacctgtaatcatttcagttggaattacaaagcaggtcagctgaaaagagtcagcctgtgaagcattgtatttaacttggattcacctggaaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcntgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacangagcaagccctctcgggctatatacagaggaagaacagggtgatgagggtactgggggcaagagacatgtttgcagaaccctttaggatggtctaggcttgggagtctcactgnggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcgctttgtcacctaagctggagtgcagtgcgcgatctcggctcactgcaacttccgcctcgctgaggcaggagaatagcatggacctgggaggcggagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaa

SEQ ID NO: 360352 - DNA, 2298 bp, Homo sapiens
  misc_feature (13)..(13): n is a, c, g, or t
  misc_feature (17)..(18): n is a, c, g, or t
  misc_feature (20)..(20): n is a, c, g, or t
  misc_feature (24)..(24): n is a, c, g, or t
  misc_feature (869)..(869): n is a, c, g, or t
  misc_feature (1273)..(1273): n is a, c, g, or t
  misc_feature (1387)..(1387): n is a, c, g, or t
aaaaaaaaaaaanaaannanaaanagaagaaaaaaaaaagaaaaaaaaaatttcagctgttggccagggtctactctctggccctggtggatgcccatattccttttcatgtgatcctctgcatcttcaagcaacaatgggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcntgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacangagcaagccctctcgggctatatacagaggaagaacagggtgatgagggtactgggggcaagagacatgtttgcagaaccctttaggatggtctaggcttgggagtctcactgnggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcgctttgtcacctaagctggagtgcagtgcgcgatctcggctcactgcaacttccgcctcgctgaggcaggagaatagcatggacctgggaggcggagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaa

SEQ ID NO: 360353 - DNA, 846 bp, Homo sapiens
  misc_feature (107)..(107): n is a, c, g, or t
  misc_feature (131)..(131): n is a, c, g, or t
cgctcgagtaatataccagaagtatttggatttattgaagacatcacagaatccacttctatcttggagggcttgtacccaaacagcattacaacagcagttttaangtcctctctgctgagatatccttngtgatcttcatcacatgctttaaataccgcggccacgcccaccgcggttcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaggcattttcagtgcatgatttaacttcggctgtcatcaggaagctgacttaaagttctttcttgactttgcctgccatcaacaccctgtggtatttctggctggcatttttctctgcatggatatgtttacttctccatgcctaggaaccttctccatctcattccagtcactaattctacccacggtacatcttctctgtcacagtgatttgagtgtgggtgctatgagaccttccttcttcagaataattctgtctgcaatgaaaaacagtatttgttagcttttaaaatgatagctctgaacttgaatttcctctgcactctccgtgagatgaccagacctgcttgtatatatgcgatgacgacgaaaagtcagaagacattaagtatttcagcatgtctcatttgaaatatgaatttaaaatgatgatgccctgccattcattatgtgaataaaatgccaccccacacgttatgaataaactttccagttttaacagtg

SEQ ID NO: 360354 - DNA, 223 bp, Homo sapiens
agttttaaactgtcaaataagaggagcctaacaagatgtgacaactaaatgtcatttggtatcctggatgagatcacggaataaaaaataaacattggccggacacagtgactcagcctgtaatcccagcacttcgggaggccgaggcgggtggatcacgaggtcgggagatcgagaccatcctggctaacacggtgaaaccccgtctctactaaaaatacaa

SEQ ID NO: 360355 - DNA, 2810 bp, Homo sapiens
  misc_feature (1231)..(1231): n is a, c, g, or t
  misc_feature (1635)..(1635): n is a, c, g, or t
  misc_feature (1749)..(1749): n is a, c, g, or t
  misc_feature (2364)..(2364): n is a, c, g, or t
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcntgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacangagcaagccctctcgggctatatacagaggaagaacagggtgatgagggtactgggggcaagagacatgtttgcagaaccctttaggatggtctaggcttgggagtctcactgnggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcgctttgtcacctaagctggagtgcagtgcgcgatctcggctcactgcaacttccgcctcctgggatcaagtgattctcctgccttagcctcctgagtatctgggtttacaggtgtgtaccgccacacccgtctctactaaaaatacaaaaaacaaaaaaagattagctgggcgtggtggcaggtgcctgtngtcccagctgctcgggaggctgaggcaggagaatagcatggacctgggaggcggagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaa

SEQ ID NO: 360356 - DNA, 735 bp, Homo sapiens
cggacttcagcttggcctgggcctctcgcttcctctcccgtgtctgggtctcactctgccgggtgtgcagataagacctgggctgcctgtccaaagggtcgtggttaatgactgatcctggagctgcagggctcctggctccccgtccaggactacggctacctccaagttccatctcctttctctctatatagtctattaatggtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaattt

SEQ ID NO: 360357 - DNA, 691 bp, Homo sapiens
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagaaacctggaagtcatcccaagttcctttctttttcttaccctccacatccaagctgtcaacaaatctcgactctgaccacctctcagcacctccactgtgtcacccagtgcaaacctccaccaccatctcagcctcttacccagctccaggattctgcctttgcccccatcaatctacttcaggtctctt

SEQ ID NO: 360358 - DNA, 2501 bp, Homo sapiens
  misc_feature (107)..(107): n is a, c, g, or t
  misc_feature (131)..(131): n is a, c, g, or t
  misc_feature (1072)..(1072): n is a, c, g, or t
  misc_feature (1476)..(1476): n is a, c, g, or t
  misc_feature (1590)..(1590): n is a, c, g, or t
cgctcgagtaatataccagaagtatttggatttattgaagacatcacagaatccacttctatcttggagggcttgtacccaaacagcattacaacagcagttttaangtcctctctgctgagatatccttngtgatcttcatcacatgctttaaataccgcggccacgcccaccgcggttcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagggaagtagatcgagattcagatggtcacgtcagctttagagactttgaatatgccctgaactatggacagaaggaagcctaactattgtgaactacttttggtaactctggggagatcaatagattgtaatgtcagcagactctactctactaatgatgtcatgctactgacttgtgattaaacatttaaaaatttttaatttttgtgggtacatagtaggtgcatatgtatacatacacacacatatatgggttacgggagatattttggcacaggcatgcaataagtaattgactaaatttttaatcataatttttggatgctgatgatagacttgcatctcagaatcctagagatggttgctgccgggggtctccttctgtgtggccagcagccctgagtcaggccgccattgctagagctggggctagggatggcactggtggtcctcctcctcctcactcttcttgccccctaccctctccacactgcaggccacggtgctctactcactcacttcattgtcctcaccatcccaccctgaatctcatcatctcctaatatctgcagaggggcagacttttcctgccaatggtgccagtttccttcatttgctcaacattggttgaacaaataatagcacctacacatacagaatacttactatgttccaagcaatcagccaggccttgggaagcataggcttaagacttctctaagataggctcntgcctacaatcccagcactttgggaggccaaagcaggaggatcacttgagcctaggaattggagactagcctgggcaacataccgagaccccatccctaccaaaaaattaataataaaaaattatctggatttagtggtgtgtacctgtagtcccagctacttgggaggctgaggtggaaggatcatttgagcccaggggtttgaagcttcagtgagccatgattgcactgtcgcactccagcctggatgatagagcaagaccctgtctctaaaaaaacactttcaattaaaaaaaaacatataaagacttctctaagataatgtccctgagtccaaatcatcactgtaaagtggtcccagggcactgtctgtgcaagacaaagaaatcggcttgggctaacangagcaagccctctcgggctatatacagaggaagaacagggtgatgagggtactgggggcaagagacatgtttgcagaaccctttaggatggtctaggcttgggagtctcactgnggagaagcaagccttgagctgctcagctgccctctgctccataccccctggtttctagcagtcacgtcctgcacccagacacttagccatgtgtgttcacgttccccatgccttgcctgtcctgctgggctccagtaactgctatactggagcaagaacagcaatgctggacactcagcatttagtgaaggtaattccaaaatactggtatcagtactcttatttataagtgtacggaatgcataacatgaacattagtcaaagaacttttaatataattcactttttaagtgttaaaatttaaaggtcaagtaaaattgtaaatttgtaatatggaaacattaagcgtcattatcatacaaattattagcagataaccttaataaaaataaacgtttgcgggttttttttgagacagagtctcgctttgtcacctaagctggagtgcagtgcgcgatctcggctcactgcaacttccgcctcgctgaggcaggagaatagcatggacctgggaggcggagcttgcagtgagctgaaatggtgccactgcactccagtctgggcaacagagcgagactccctctcaaaaaaaaaaaaaaaaaaaaaaaaaaagacattaagtagaaacaaatcaagcatggactttagctaataataatgtatcactattggttcattaattgtaacaaatgtatcctactcatatataatgttaatagtaggggaaactgggtgaggtatatgggaaccctctactattttcacaatttttctataaatctaaaactattctaaaattaaaaattcatttaaaaaataaagtcttattcaaaacctgttaaactaaactttatctaaaatgaagaaaacattgaaaatcaagtaaaaataaaatcttatttcaaatacaa

SEQ ID NO: 360359 - DNA, 586 bp, Homo sapiens
cgcggtgggcgtggccgcggtaggctgccagccaggctgggaaagcggtggtagctggttgggttgctggggctcggttgttgtagtcgcgatgttcttctccgaggccagagccaggtcgcggacgtgggaagccagtccctcggaacacaggaagtgggtggaagtatttaaagcatgtgatgaagatcacaaaggatatctcagcagagaggactttaaaactgctgttgtaatgctgtttgggtacaagccctccaagatagaagtggattctgtgatgtcttcaataaatccaaatacttctggtatattactcgaggggtttttaaatattgtcaggaaaaagaaggaagctcaacgatatcggaacgaagtaagacacatcttcacagcctttgacacctactatcgtggatttttaactttggaagatttcaaaaaagcatttaggcaggtggctcccaaattaccggaaaggactgttcttgaggtattcagtgatttataagacgttgaaatgcattaccaagagcagttattgaatcttccttcagagataattaacgaaaagactgttattaaa

SEQ ID NO: 360360 - DNA, 382 bp, Homo sapiens
gatcacttcacactggggcaaggttccttagagcaggaaggccaggagacattcagtgccttctctgcaccttgtgatgaataggatctacttatgacagactaactctgtcctcaacctcaaccaggcagcggctcctagcctggttaactttcaaatgtgctagtgagggacaaaggcacaaaaccaaatggaaagtattgcacacattcagtgagagaggtggatgcagtcagccaattaggggagacgtggaacagatgactcctgacacggctggagaaggcggggagttttctaatacatattggattccgttttcaccaaaggtcagctttaatcaagttcccaatgtaaatattaccaatataaaccaagtaat

SEQ ID NO: 360361 - DNA, 792 bp, Homo sapiens
atacagtatggtacacaattttaatggaaggaaccacaggtatgttgaaagaacatcagtacagctggagacagggagggaccatatgatatataactcctaaaagccggaaggagttattatcacataatttctgggcgctacagaagtttttcatcactcactagtattacataatttgctagggatctattaagaaacttcgagtagcctgattagaagaaaagacattaggaaaagcaagtctcaagagttggaaagaggaaaggaacatggcatcagcaaatccggagtggctggcagtgggggcagagggttgctagagaggactgcaggtggagaaggaggtactgaggtactgaggtactgaggtaacatactgactgtatcctcttccaggaaggcaaggttcagaagtaagagctggagaaagagggccacatgcaaattccaaaatagaaccctgagggcaccctctagatattcaaaatatccccatgctcccctatgatcataagcaatgataatccatataaatcatttccatttccagtgttgtatgtaatacagggatatagaattcagattcaaagcctatgcttttttctcatgatgccataacactgcatgagccttgagtttgaaattaatttggatttgaagtaataaaaataaatttaggtataatgtactcattaccataatgtaatgggtgcactaaaatctcagaattcaccactatataatgtattcatgtaacaaaaaaaacacttgtacctcaaaagctattga

SEQ ID NO: 360362 - DNA, 426 bp, Homo sapiens
ctcttgctttacagtcaattgatgagatctttggatggtttgcatcattttttaatcctatataaatatttgtttctttcatttgcctattttggctttctttagaaaatggtcttagtttattgaaattatcgccagtgctttaaagagtatgacttccagtcaattcagttccacagttttattgagcaaatatcatggattcaaaattagcgcacactctaacccaaggtcatatagagtggtataaaggactttacagactcagcagggggagggtgcgaggtagcatagagataaaaaattgcatattaggtataatgtactcattaccataatgtaatgggtgcactaaaatctcagaattcaccactatataatgtattcatgtaacaaaaaaaacacttgtacctcaaaagctattga

SEQ ID NO: 360363 - DNA, 909 bp, Homo sapiens
ctttttttcagtgttttataattcattactgaccttttcatgctcaaatttttccagaattggttagtgagcattccttcaaaccacccttgtgtccttttgacatgtgcttataacttttttggaggacttactttcagacacaggatcttccattatctccagggcagcttggtctcaaggagaattttagtaggaaagaaaaacagcaactaaaactataataccaaaagcctgaacagatgagatgaagtagatagttgacaaagtttcctgctttttagttgatataactcttgtagcttatgttgtcaaccctgttttgttgaatgctttttagttgcctgtaggtgtgctgagacagacattgccagcagggttttgaacacagggatagagatgtgtctgaatgtacgttacggtggtgagagtgagaaaggagacctctcctgagaaggtgaaaagcagctgttgaaaaagcaagaggcagtaaactgctcttgtatttcaagccttcccaccaccatttctctagtccagggggctcttccttttaacattaaaatgtgtgtcttctaatttcccagtgatccctccaagtctgtgggatggcctggaatgtaaaaacacttagcaaatacttagtgattaaaagaaaacaatggcggaagctttaagaattgaaaaatcaaaataataagtagagaatttgtccaaacctccccctgccgacattcccccatccccagaaaggaagaaaatgtatgtagataaaaggacagagaaagacagggaaagctgtggtacggaaagaaagagtgtggccacgagcttccagtatgctcactgccaaggaatcctgacacgttctgtttctctgtataaaatcatgaacaaataaaaaaaaaa

SEQ ID NO: 360364 - DNA, 96 bp, Homo sapiens
gtactgcatatgttaatcagctcaatgtagccattccacaatatatatatattttaaaacatcatgttgtacatgataaatatgtacaacttttat

SEQ ID NO: 360365 - DNA, 412 bp, Homo sapiens
gtgatccacaatcaattcagaacctggtcttctatggtggctcacagttcctgcaccctacaatatcgtgaattttcttcctcttcatctaatgacatgaatatgctccagtggatcctaggatatctttcacatgaggttacccttgccctttggatgtcaggtggaacaaagggatggaagattttttgtactgggacattcagtaaacccctaggcctacctattgtctagtcagagttagagaagcaaatgatgtctgtgagggcctacaaggcacaagaggatgaaagtttaacttaaagtttagatgctgatattctagctagtaataatgtatgattgcctcatgtactactctttttttatatttctctcctaatgtataaagatggatttcaaaagataggca

SEQ ID NO: 360366 - DNA, 1206 bp, Homo sapiens
  misc_feature (27)..(28): n is a, c, g, or t
tacggctaggtagcgaggcctgggtgnngcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360367 - DNA, 554 bp, Homo sapiens
ggctaatggatgggtggatgcaaatgaatgtttgcatttgaatgaaatgactgagaacaaatctttgcctgctttcaagttgctgagcgtccctctactgcctaagatgaggggtttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggtaagtgtctaatttttgacttaaaatcgaagggagtccaaaccttcatatttttactcccctcatggtggcccactttcagcagatttcatgaagacaaattttagcctcttttcatttttttaaatagagatagggtctcgctgtgttggccaggttggtcttgaactcctggcctaaagcaatcctcccatctcgacctcccaaagtgctaggattacaggcatgagccactgtgccctgccagaaac

SEQ ID NO: 360368 - DNA, 1223 bp, Homo sapiens
gcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360369 - DNA, 3166 bp, Homo sapiens
gcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggatgggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaaccagagtaagatttataacagctgagcacttaatttggctctctgagcagacagtaaaacataacaggatgcatgattatcacttgacattttttcctggcaccacattccaagcagaattgattccttgtactcttacgtggaggatatagagtaataaaacacgtaatttatttgaaagcatttatagagaagacaaacactggtcatgagcttcaggtacccttcattccctcatctgcctgtattatctgccccttcctcgggggctccttttcttgccatctgcataacagccacattcaccatcttatgagtccttcatatttctattttaccaaacaaagtggcggtaaggtgtgtgccctggagaacggtgtgtcaggagttaagaatctcatccctatgttatgtttcatcttggctgtctgcaaccctggccaagtcacccaccctgtatgggcctcagtttccccatgtttacaatgagatactgagctgaatggtaaccaaaagaatcagagtttgcatgtattgagagcattctatgttccacgtacattctgtaatatcaccaatccttacagtcatctgacaggataagtttccatttgacagagaaactaaaacgtggcctataccccacagactgggatttgaacctggctccgcctacatagcctcagccctttcctttgcactttgttgtaaaggctcctcctctgagtctctgaattcaatctatactggttgaattcctgccatgtatgagatattctgagcagtgtagggggcaacagagtgcctgctcccaaggtactgcctggggaagactgatcagggaccttgagtgtaaagtaaagtagtgtgcactagttacttctgtgaagctggcactgaatgttcattttgtccacagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctgaattctcagttcccttgctgatgctgtcaggtgtgtttgagtgaggcgagggcaggaatggcggtctccagggacctggctgtcatccacctccacctgctccttagacagcagatgtttctgggctaggccctgtgtcagcccactggagacagaaaaagatccagtgatgcaatctc

SEQ ID NO: 360370 - DNA, 1084 bp, Homo sapiens
gcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360371 - DNA, 927 bp, Homo sapiens
cattttcctcttggcagtgtgaaattcctctgcctctttaattcagttccttttgctcaagaacactgtcggggggcagaggggagcccacctttcctgtggccgagggcaggaacccaacaagctcctctctgttcccccacaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360372 - DNA, 651 bp, Homo sapiens
gcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcaataatcatggcaaaaaaatcaagtcttaaaaataaagtgccattctct

SEQ ID NO: 360373 - DNA, 690 bp, Homo sapiens
  misc_feature (27)..(28): n is a, c, g, or t
tacggctaggtagcgaggcctgggtgnngcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggtgagtcctctgctgctctgtcatttgtcactttagcagaccaagggtcagcaggcagcctggtgacttccggcttagggccacctccagcccttgctcatcctttctgttcccagctactggagaggctagcaggcgccaaagcccagtgagaatctgtgggaaggatgccattgttttaaaaacacattgtctctggccgggcttgatggctcacacctgtaatcccggcact

SEQ ID NO: 360374 - DNA, 568 bp, Homo sapiens
cattttcctcttggcagtgtgaaattcctctgcctctttaattcagttccttttgctcaagaacactgtcggggggcagaggggagcccacctttcctgtggccgagggcaggaacccaacaagctcctctctgttcccccacaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggtgagcaggagggagggggttcccttcttgggccatttactatggggaaggcgtagtcttttttataaccaaaattctaacaaacatggcatactttataatttgaacatcctttgacagtcttgctgttaccaaat

SEQ ID NO: 360375 - DNA, 1239 bp, Homo sapiens
gcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcacttgatttttaagacttgatttttttgccatgtcgacccgccgcgaatttag

SEQ ID NO: 360376 - DNA, 954 bp, Homo sapiens
ggctaatggatgggtggatgcaaatgaatgtttgcatttgaatgaaatgactgagaacaaatctttgcctgctttcaagttgctgagcgtccctctactgcctaagatgaggggtttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360377 - DNA, 951 bp, Homo sapiens
  misc_feature (27)..(28): n is a, c, g, or t
tacggctaggtagcgaggcctgggtgnngcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgccaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctct

SEQ ID NO: 360378 - DNA, 269 bp, Homo sapiens
tgagagagcagtcttctgtcagctcctcccctcccgtttcttctgttctcattcgatgttagttggttgacaagagtgttaaaactcttctgttttgcttttcctagcggtttctttgggttgtactcagaaaaaaaacaagcaatgtagaaataaaatctccttggtcctttagaacagtgattttcaaccaaggggctttttcaaactacattccttagctcccttgctactatttttttttttttttttttgagatggtgtcttgc

SEQ ID NO: 360379 - DNA, 2435 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360380 - DNA, 2472 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360381 - DNA, 3006 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaatggacaagatccctgccctcaatctattagggaagatattcttgaagtgagagcggctaatcataggcaaaaaatccccatgaagccaggagatctggggcagagagtggagtgaactcacttttcacaatgacccagcaacatgggagagggtgggggctggatttcagcccagccactgtgctgatggtgcacagccctttaatgctgtgtatcatctcttttcttcacagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360382 - DNA, 2065 bp, Homo sapiens
cataggtagtacgaggctggtttgaatcggccgagggttgtgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360383 - DNA, 2515 bp, Homo sapiens
  misc_feature (2446)..(2446): n is a, c, g, or t
  misc_feature (2452)..(2452): n is a, c, g, or t
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggttttttggaanaaaagnggaaaggattttttatggtttaaaaataatataatcttgagggggggcgccggtccccaattt

SEQ ID NO: 360384 - DNA, 3418 bp, Homo sapiens
  misc_feature (3241)..(3241): n is a, c, g, or t
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaatggacaagatccctgccctcaatctattagggaagatattcttgaagtgagagcggctaatcataggcaaaaaatccccatgaagccaggagatctggggcagagagtggagtgaactcacttttcacaatgacccagcaacatgggagagggtgggggctggatttcagcccagccactgtgctgatggtgcacagccctttaatgctgtgtatcatctcttttcttcacagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggaaaaaaaaaaaaaaaaaaaaaaaaaaaaaaaaaaaaaaaaaaaacgcgggggaatttttgggggggggaaaaaagggtaaaaaaggggcatgggacacataccgggttgtccagcgaccgccactttttgtgttacacaaggggggaaaatctggggggggccccccaaataagagaggcggaatatatattgcagaaagccggagtatccctgttttatgactgtgcgcacaancgcagagcagaccacgacaggagcgacatgatgacgagaggccgcacgacagaactgaaacggagagacagcagcagcgaaagcagaacgtacaacgttaacacgagagagagacctgaaggtaggcgcagagcaacagagattgagtcagagcccaaatacgacgactgcatactg

SEQ ID NO: 360385 - DNA, 1549 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgaggttccactgccttaaggatgacagtcgtagggaaccctcgaagttggagctgccagtggttgccaatcctgatactgttgcctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360386 - DNA, 2792 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggtgaggactttcctttccctggtgggcctttctggacttaggaatgaagaacacattgtggctggtcacagtggctcacacctgtaatcctagcactttgggagaccgaggccggaggatcacttgagcccaaaagtttgagacaagcctagacaacatagtgagaccctctctctataacaaaaaattagccgggcatggtaggttcacatctgtaatcccagctacttgggaggctgacccaggaggattgcttgagcctggggagccagggaggttgaggctacagtgagccatgattgcaccactgcactctagctgggctgacagagtgagactgtctcaaaaaaaaaaaaaagaacacatcatagaacttgggatagagtcaggatgaggcttgaagggaaggaatattgtaaaagaaagaagaaaaccaaaaaaaaacaagaatgcatttcttttgaatagtttaaaattactaagccctcaaaatgtcctaggcagtgtggaaagcactcagcaataactgtgtgaagtaggtaatatttccattccacagatgaggaaactgaactaaaggctgcttaagtaacttgtctgagattacactcctaaaaagtagtgaactaggtttcagcagtctgacttgtattctcacccattacactaaaataacacccttgaatttttattttgaaggtgggcccactctaggctttcaaaccagattgccctttcaaaggcagtagtagtctctgttctgaacccttcttgttcccaattctgtgtgtctgatttttatcccatcacatttatatttgaaccaaggctttctgaaaacagggccttaatccaaaggaatgtctcatgctaggaattaccaactccaaggcaagacaggcccctggaggcagatggatttgtgctactctcagattatgtagtagctacctggatccttaatgacaccgggttgggggatggtgttggtaagataaagagcaaagagtccgggtgtggtggctcatgcctgtaatcccagcactttgggaggccgaggcaggcagatcaccaggtcaggagatcgagaccatcctggctaacacagtgaaaccccatctctactaaaaatacaaaaaattagccgggcgtggtggcgggcgcctgtagtcctagctactcactcgggaggctgaggcaggagaatggcatgaacctgggaggcggagcttgcagtgagcagagatcgcgccactgcactccagcctgggcgacagagcgagactctgtctc

SEQ ID NO: 360387 - DNA, 2561 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggtgaggactttcctttccctggtgggcctttctggacttaggaatgaagaacacattgtggctggtcacagtggctcacacctgtaatcctagcactttgggagaccgaggccggaggatcacttgagcccaaaagtttgagacaagcctagacaacatagtgagaccctctctctataacaaaaaattagccgggcatggtaggttcacatctgtaatcccagctacttgggaggctgacccaggaggattgcttgagcctggggagccagggaggttgaggctacagtgagccatgattgcaccactgcactctagctgggctgacagagtgagactgtctcaaaaaaaaaaaaaagaacacatcatagaacttgggatagagtcaggatgaggcttgaagggaaggaatattgtaaaagaaagaagaaaaccaaaaaaaaacaagaatgcatttcttttgaatagtttaaaattactaagccctcaaaatgtcctaggcagtgtggaaagcactcagcaataactgtgtgaagtaggtaatatttccattccacagatgaggaaactgaactaaaggctgcttaagtaacttgtctgagattacactcctaaaaagtagtgaactaggtttcagcagtctgacttgtattctcacccattacactaaaataacacccttgaatttttattttgaaggtgggcccactctaggctttcaaaccagattgccctttcaaaggcagtagtagtctctgttctgaacccttcttgttcccaattctgtgtgtctgatttttatcccatcacatttatatttgaaccaaggctttctgaaaacagggccttaatccaaaggaatgtctcatgctaggaattaccaactccaaggcaagacaggcccctggaggcagatggatttgtgctactctcagattatgtagtagctacctggatccttaatgacaccgggttgggggatggtgttggtaagataaagagcaaagagtccgggtgtcattaaggatccaggggcctgtcttgccttggagttggcggccg

SEQ ID NO: 360388 - DNA, 1710 bp, Homo sapiens
aaaaacacagaacaaagaataatgggacctgaaagggtggaggtgaaggcagtcgactctgcagggacatccaggagcatgagtctgccgttagagtggcaggctgcttcagccccctccccttttggtcctggatgtaagtgggtgcccttagagatgtagctcctagtgttgaccctccctccgggggcccatccctgcagtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaatggacaagatccctgccctcaatctattagggaagatattcttgaagtgagagcggctaatcataggcaaaaaatccccatgaagccaggagatctggggcagagagtggagtgaactcacttttcacaatgacccagcaacatgggagagggtgggggctggatttcagcccagccactgtgctgatggtgcacagccctttaatgctgtgtatcatctcttttcttcacagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360389 - DNA, 714 bp, Homo sapiens
cgtcgtagactggtaaaacccaggcgactgtaggaggctacctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360390 - DNA, 1547 bp, Homo sapiens
attcctctgaaattgctagaagagacacaggtgaggcctaacttgggctttccgctaccgtcctgcaggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggtgaggactttcctttccctggtgggcctttctggacttaggaatgaagaacacattgtggctggtcacagtggctcacacctgtaatcctagcactttgggagaccgaggccggaggatcacttgagcccaaaagtttgagacaagcctagacaacatagtgagaccctctctctataacaaaaaattagccgggcatggtaggttcacatctgtaatcccagctacttgggaggctgacccaggaggattgcttgagcctggggagccagggaggttgaggctacagtgagccatgattgcaccactgcactctagctgggctgacagagtgagactgtctcaaaaaaaaaaaaaagaacacatcatagaacttgggatagagtcaggatgaggcttgaagggaaggaatattgtaaaagaaagaagaaaaccaaaaaaaaacaagaatgcatttcttttgaatagtttaaaattactaagccctcaaaatgtcctaggcagtgtggaaagcactcagcaataactgtgtgaagtaggtaatatttccattccacagatgaggaaactgaactaaaggctgcttaagtaacttgtctgagattacactcctaaaaagtagtgaactaggtttcagcagtctgacttgtattctcacccattacactaaaataacacccttgaatttttattttgaaggtgggcccactctaggctttcaaaccagattgccctttcaaaggcagtagtagtctctgttctgaacccttcttgttcccaattctgtgtgtctgatttttatcccatcacatttatatttgaaccaaggctttctgaaaacagggccttaatccaaaggaatgtctcatgctaggaattaccaactccaaggcaagacaggcccctggaggcagatggatttgtgctactctcagattatgtagtagctacctggatccttaatgacaccgggttgggggatggtgttggtaagataaagagcaaagagtccgggtgtggtggctcatgcctgtaatcccagcactttgggaggccgaggcaggcagatcaccaggtcaggagatcgagaccatcctggctaacacagtgaaaccccatctctactaaaaatacaaaaaattagccgggcgtggtggcgggcgcctgtagtcctagctactcactcgggaggctgaggcaggagaatggcatgaacctgggaggcggagcttgcagtgagcagagatcgcgccactgcactccagcctgggcgacagagcgagactctgtctc

SEQ ID NO: 360391 - DNA, 2231 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360392 - DNA, 2847 bp, Homo sapiens
  misc_feature (2670)..(2670): n is a, c, g, or t
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggaaaaaaaaaaaaaaaaaaaaaaaaaaaaaaaaaaaaaaaaaaaacgcgggggaatttttgggggggggaaaaaagggtaaaaaaggggcatgggacacataccgggttgtccagcgaccgccactttttgtgttacacaaggggggaaaatctggggggggccccccaaataagagaggcggaatatatattgcagaaagccggagtatccctgttttatgactgtgcgcacaancgcagagcagaccacgacaggagcgacatgatgacgagaggccgcacgacagaactgaaacggagagacagcagcagcgaaagcagaacgtacaacgttaacacgagagagagacctgaaggtaggcgcagagcaacagagattgagtcagagcccaaatacgacgactgcatactg

SEQ ID NO: 360393 - DNA, 2266 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360394 - DNA, 2073 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360395 - DNA, 1190 bp, Homo sapiens
attcctctgaaattgctagaagagacacaggtgaggcctaacttgggctttccgctaccgtcctgcaggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360396 - DNA, 1139 bp, Homo sapiens
aaaaacacagaacaaagaataatgggacctgaaagggtggaggtgaaggcagtcgactctgcagggacatccaggagcatgagtctgccgttagagtggcaggctgcttcagccccctccccttttggtcctggatgtaagtgggtgcccttagagatgtagctcctagtgttgaccctccctccgggggcccatccctgcagtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaagg

SEQ ID NO: 360397 - DNA, 2214 bp, Homo sapiens
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggtgaggactttcctttccctggtgggcctttctggacttaggaatgaagaacacattgtggctggtcacagtggctcacacctgtaatcctagcactttgggagaccgaggccggaggatcacttgagcccaaaagtttgagacaagcctagacaacatagtgagaccctctctctataacaaaaaattagccgggcatggtagtgcacatctgtaatcccagctactagggaggctgaggcgggacaattgcttgcagtgagccgagatcgtgccactgcactgtagcctgggcaacagagtgagactctgcctcgaaaaaaaaaaaaagcgcccctcacaaggcctggctcttaagctcaaaaatggtcatttctacagctcttgggcctgcctatgcctctcaccagaaagaaggttctctctgctgacctggctccctgggctctgtaggaacttcaggagggatctcttcaactctctctgggattgcagcctctaagaggtgtcgaatctttggagagggattggaaacaaaagatagggttcagcttcagccccctgctttcccacttttcacagccttcttcaacaatgcacggtaatctccttttatgcctaattcttgttgcattgacatcagcttgcagtaaactcacccgccctctggtcttctttcctcagttcctgttctcacctccctccccaacccgca

SEQ ID NO: 360398 - DNA, 1480 bp, Homo sapiens
  misc_feature (1303)..(1303): n is a, c, g, or t
ccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaaaaaaaaaaaaaaaaaaaaaaaaaaaaaaaaaaaaaaaaaaaaaacgcgggggaatttttgggggggggaaaaaagggtaaaaaaggggcatgggacacataccgggttgtccagcgaccgccactttttgtgttacacaaggggggaaaatctggggggggccccccaaataagagaggcggaatatatattgcagaaagccggagtatccctgttttatgactgtgcgcacaancgcagagcagaccacgacaggagcgacatgatgacgagaggccgcacgacagaactgaaacggagagacagcagcagcgaaagcagaacgtacaacgttaacacgagagagagacctgaaggtaggcgcagagcaacagagattgagtcagagcccaaatacgacgactgcatactg

SEQ ID NO: 360399 - DNA, 424 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360400 - DNA, 385 bp, Homo sapiens
  misc_feature (16)..(16): n is a, c, g, or t
  misc_feature (24)..(24): n is a, c, g, or t
tactaaattcgcgggngctgcttnttttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360401 - DNA, 394 bp, Homo sapiens
  misc_feature (8)..(8): n is a, c, g, or t
  misc_feature (14)..(14): n is a, c, g, or t
  misc_feature (43)..(43): n is a, c, g, or t
  misc_feature (45)..(45): n is a, c, g, or t
  misc_feature (47)..(49): n is a, c, g, or t
ggcacganctcgtncaattcggcagaggattcggcacgagatncngnnngagcaggcgcaccacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360402 - DNA, 383 bp, Homo sapiens
  misc_feature (12)..(13): n is a, c, g, or t
  misc_feature (18)..(18): n is a, c, g, or t
  misc_feature (20)..(23): n is a, c, g, or t
  misc_feature (29)..(31): n is a, c, g, or t
tgccgggtgacnnagctncnnnngttctnnntcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360403 - DNA, 359 bp, Homo sapiens
gccgcagtggtgctggattcggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360404 - DNA, 831 bp, Homo sapiens
ggaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccaggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctcctcctgacctttggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360405 - DNA, 361 bp, Homo sapiens
gaattcactagtaatgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360406 - DNA, 634 bp, Homo sapiens
  misc_feature (16)..(16): n is a, c, g, or t
  misc_feature (24)..(24): n is a, c, g, or t
  misc_feature (422)..(422): n is a, c, g, or t
tactaaattcgcgggngctgcttnttttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaanaaaaacaaaaaaacaaaaaaaagagaaagaaaaaaaacgaaataaacaaccgaacaggaaaacaacagcaaggagggggcgcccaaataatcatcgccaaggggggccgcacaacagcggcacgcaatctttcctcagacagggggccccacaacaacagcgtattatacagaagaccgcgcgtggccgcgaacaaaacagagagcgagcga

SEQ ID NO: 360407 - DNA, 985 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaagccagtttgaggagttcctgaaccagaagttcgcccttctacttctggatgaatggtgaccgcattcgactcccttgctggagaacgaccggcagcagacgcacattgctggatgtcatgcaggaccatttcagccgcgcgtcagcattcatagacgagctcttccaggacaggttcttcacccgggagccccaggataccttaccactacctgccttcagcctgcccacggaggcctcaccttcttctttcccaagtcccgcatcgtcccgcagttgatgcccttcttctccgtacgagcccctgaatttcacgccatggttcaggcctttcttgggatgatccccgggggtctcgcaggcctgggcattccactttcatagccgggcttcaggcccccgccaacggattctacgagaagggggcgataccggtgtgtgccggggatctcgccaatcccgggtgctggtataagcacttggacaggcgggactcttttgtggtgtcccacacttccggtatgggggaggcccaccccgcggcgtgac

SEQ ID NO: 360408 - DNA, 656 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaccacccagccaactcccccaaccccaccttaaccttaatttcacattttccccttatctcaccacttttctatcaactgccctctcttcacaacctcactacctgtcactgcctggcgtacactatctatatcccgtactgtatcatgccgcctcctcggaccccttcctggcgacaagcctattaggcgcggccttcacacctggtgggaactttaatcctcacgggcgcc

SEQ ID NO: 360409 - DNA, 719 bp, Homo sapiens
  misc_feature (531)..(531): n is a, c, g, or t
  misc_feature (552)..(552): n is a, c, g, or t
  misc_feature (554)..(554): n is a, c, g, or t
ccgcccccccccctctcaaaaaaaaaaagctataccatgcttacgcaaagtaataatcgaaaaaccactgcgaaacctgatacgcctacaataaccataccaaaataaaaaaagctgccgcctactactactaaattcgcggccgcgtcgacagcagacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaaaaaacncggggggatttttgttggggngnggggaaaaaggggtaggagaaaggggccaagggggaaaagcgcgggtcccgggacccaggcttttttgggaacaagggggggaaaacgggcgggggacccaaaaaggggagaggcggaactaaattgcgaaaagccggggaaccggggataataaacggacaaaa

SEQ ID NO: 360410 - DNA, 516 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaa

SEQ ID NO: 360411 - DNA, 915 bp, Homo sapiens
  misc_feature (568)..(568): n is a, c, g, or t
gaattcactagtaatgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaactcggagactagtttcttcttcttctcttccacggggcctccggtaggccaccaacgtggcaagggaccccttcccccttgcggggcggcctccacatgggcgcacaagttcggcggttcgagaagagtgaacctggaactcgcgctggcgttcaagcgtgggatggcgacccaattccccaaatggcgaccncccgtgggagccgcatgggacagcggcaaaaggcgcaagagaacgccgagaagggccccgggcgcccctcaaccccagtggcggggcgcgccaaacgcgaatccacaagagggcccgcgccagagaacctcgcgggaccgagaactccgtgggcaaactccagattccagagggttcagaagccactccctagagaaaaccgtgggcgggtggacccggtaaaatccccacatgcgcaggtgtctgccccaagattggcacgggtgggccagggttcgctctctgaggcaaggggagagaccaggcgtgagaaacaggccagagagccccacccaaggaagggaccc

SEQ ID NO: 360412 - DNA, 441 bp, Homo sapiens
  misc_feature (12)..(13): n is a, c, g, or t
  misc_feature (18)..(18): n is a, c, g, or t
  misc_feature (20)..(23): n is a, c, g, or t
  misc_feature (29)..(31): n is a, c, g, or t
tgccgggtgacnnagctncnnnngttctnnntcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaagaaaagcaaaatgatgataatgcaataaggaaccaaaggataaacacactgaggc

SEQ ID NO: 360413 - DNA, 656 bp, Homo sapiens
  misc_feature (378)..(378): n is a, c, g, or t
tgaggccacaacaatggctaggtcgaggctggtgtgttggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaanacaatgtataaattcattctattttggttctattttttaattaaatctatcaagtataatcctaaattgcaaatttgttttataaaaaaaactttgttggccgtttggccacaattgcttttaacttgaacaagttttttcattcggcccgaatttggggccaatttggccaaatcaccttttattggggttgtttttaacatatagtgggccgggttttaaaaactttctgtctgtggaaaacctctggggtcccccaatttatatcctctttgaac

SEQ ID NO: 360414 - DNA, 576 bp, Homo sapiens
aagcatggtatcaacgcagagtgcccattacggccgggcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaagggcgggcgctcgcgcccacgcgttccgcggacgcgtgggcccgcggtgaggttgtctagtccacgctcggagccatgccgtccaagggtccgctgcagtcggtgcaggtcttcggacgcaagaacgacagcgacagctgtggcgcactgcaaacgcggcca

SEQ ID NO: 360415 - DNA, 287 bp, Homo sapiens
  misc_feature (19)..(19): n is a, c, g, or t
ctcgtgcgattcggcagangtaaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360416 - DNA, 758 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaaaaaaaaaaaaaaaaactcgagactagcttctctcaaataataaccatacacaacactaaggggcgaacctgatctcttatacaagtatccttagtcatttcttttgtgcgcacaattaacctcctcggactccggctcactcatttacaccaaccacccaatatctttaaacctagcatgggcatcctcttatgaggggggcgggataaaggagtcggcctaagataatatggcctagccat

SEQ ID NO: 360417 - DNA, 422 bp, Homo sapiens
gtcttaggtggtttcattaaatgcagcacttggttagcagatgtttaattttttttttaacaacattaacttgtggcctctttctacacctggaaatttactcttgaataaataaaaactcgtttgtcttgtaaaaaaaaaaccaaaaaaaaaaaagaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360418 - DNA, 273 bp, Homo sapiens
tctgcggtaccctaagtatcccggctatacatatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360419 - DNA, 471 bp, Homo sapiens
tgcagatgcctccccgaagcagtggccctggaaacctcaaacagcctcttgccaggggcatgaaggccatacagggccaggggaggcagaagcagtttgttgggccccttgcagcttccagataccaagcctgactgcggcagctccagagagggccccagactttcttcccctgaccccagtcctgggcacatgtccttgtcacctccctgccctgcactccagggcagggaggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360420 - DNA, 587 bp, Homo sapiens
cgtgggtgtcatccaaccgtgaccagaaggctgctggagctggcaaaggtcccccagtctgccccgaaagctccgaaggctaaatggatacttatccctgatacctgccaccccactcttaatccctggtggacagaagccgtctcagaactgtttgtttccattggcccctttaagtcttagctagtaaaagacctggcttaactgactaacccactggcactcgtaaaaccctctcacgaaggaaatggaggaaatgttttgtggagccacctcttggctttttcttcttttgcgctgtggccacgcttttaagcttattagtttttaaaatccgtactttctaatgggaaccacttggccccaaatttgtccccgaattcttgagaccccttaaaaagtttaatgagaaaaaaaaagccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360421 - DNA, 351 bp, Homo sapiens
ccgcccccccccctctcaaaaaaaaaaagctataccatgcttacgcaaagtaataatcgaaaaaccactgcgaaacctgatacgcctacaataaccataccaaaataaaaaaagctgccgcctactactactaaattcgcggccgcgtcgacagcagaaaatgctccgctagcaatcgcatcatcggtgccaaggaccacgcatccatccagatgaacgtggccgagggtgagtcagatgattccattctccgattggccaaggccgatggcatcgtctcaaagaacttttgactggagagaatcacagatgtggaatatttgtcataaataaataatgaaaacctaaaaa

SEQ ID NO: 360422 - DNA, 985 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaatacagaatggaaaggaacgaaacatgatataaaacataacctgattggatacatggatgtcatcagcttttgaccatagacgggagagaatttccgttgatactatgacaccaagggtacgcatttgctgtacatcgggattacacctgaggaggcaagtacaagttgagcaagagtgagaaagatcttgtcgggcacaaaaggaatccctcatctggtgactcatgatgaaccggggcataccgcataacccgatccggcgtcatcaagggtggggtgataccattgcagatggataaaggagacatgggaagatcactgatttacatcaacgtgcgacacctggataaccgtgtgtaatcggtgactggaggtgaaaaacacataggaaagccaccggcgagagaaggagcccccacagaaggggacccaggaacgccggacgcagcgcacgatggtgagaatgaaaaagacaaagctggcgaaaggagatcacacccaaaaagtagggggcggcaaaaacaacgccaaacagc

SEQ ID NO: 360423 - DNA, 935 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaaaaaaaaaaaaaaaaaaaaaaaaaaaaaaagaggggggggcgcgcccaaaaaatccccccggggggcgcgcctttgcgcccccgcttttgtgtgaaaggggggcccccatgaggggctttttaaagggccgcgcagcggggcgcgcgttataaaaagcaccagcagcgagtgggggaacacagccgagccacgcgggggagatctcttggggagaaggagcccccatatcggcggggggggggagagcaaaattagggggggaaacaccctacacctaaacgaagatatattaagaaactcttgggaggggaagtaatatataaacttttcagagagggggtatataggtgggtgaaaaaccagagacgcgagatcgtatggatgtggggtggtaaaagaatattgtgggtctagcgagtgtatgtaatttcgacgaaactttattatagcgaggggcgttttagatgataaggtg

SEQ ID NO: 360424 - DNA, 1064 bp, Homo sapiens
gcggcgcgggcttcgggctcagggctggggctggggcgggagtgggggcttggacgcgggggacggggtgcggggtgctgggtgcggctggggccgtgaccctaggggccggtttgcgccgggagccggggcacggttccggccgtactcacggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaatacagaatggaaaggaacgaaacatgatataaaacataacctgattggatacatggatgtcatcagcttttgaccatagacgggagagaatttccgttgatactatgacaccaagggtacgcatttgctgtacatcgggattacacctgaggaggcaagtacaagttgagcaagagtgagaaagatcttgtcgggcacaaaaggaatccctcatctggtgactcatgatgaaccggggcataccgcataacccgatccggcgtcatcaagggtggggtgataccattgcagatggataaaggagacatgggaagatcactgatttacatcaacgtgcgacacctggataaccgtgtgtaatcggtgactggaggtgaaaaacacataggaaagccaccggcgagagaaggagcccccacagaaggggacccaggaacgccggacgcagcgcacgatggtgagaatgaaaaagacaaagctggcgaaaggagatcacacccaaaaagtagggggcggcaaaaacaacgccaaacagc

SEQ ID NO: 360425 - DNA, 821 bp, Homo sapiens
  misc_feature (508)..(508): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaaaaaaaaaaaaaaaaaaaaaaaaaagaacaaaaaaaaaaaaaaaaaaanaaaaaaaagagaagaaaaaaaaaaaaaagcacaaaaaaaaaagagagggggggaggagagtgagaagtatatcctgctgtggggggagaagactaaacaaggaggcgagagcagattttttgtgaatcacggggcggcccaccccgaaacgagggcggagtataaaaagcgaacaagcagggcgggagagaataatacaaagggggatgggaggagaagaaagaaaaaagagagacgaaaggaggaagaagagacggaggaaaaaacagtggggaggagaaagaaaggaaagagaacacaagcaacacaaaga

SEQ ID NO: 360426 - DNA, 654 bp, Homo sapiens
  misc_feature (466)..(466): n is a, c, g, or t
  misc_feature (487)..(487): n is a, c, g, or t
  misc_feature (489)..(489): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaaaaaacncggggggatttttgttggggngnggggaaaaaggggtaggagaaaggggccaagggggaaaagcgcgggtcccgggacccaggcttttttgggaacaagggggggaaaacgggcgggggacccaaaaaggggagaggcggaactaaattgcgaaaagccggggaaccggggataataaacggacaaaa

SEQ ID NO: 360427 - DNA, 652 bp, Homo sapiens
  misc_feature (460)..(460): n is a, c, g, or t
  misc_feature (477)..(478): n is a, c, g, or t
  misc_feature (480)..(480): n is a, c, g, or t
  misc_feature (502)..(502): n is a, c, g, or t
  misc_feature (504)..(504): n is a, c, g, or t
  misc_feature (510)..(510): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaacaaaaaaaaaaaaaaaaaaanaaaaacaacgggggggnntnttgggggggggggaaaaagggngnaaaganaagggcgacagtgggccaaagggggtttcccagagccccagtttttctgtgtgtacaagggggggaaatcggaggggcccccccaaagggacgcggaaatattgcagaaaacccgggtacccggctttgccccgccaaaggc

SEQ ID NO: 360428 - DNA, 761 bp, Homo sapiens
  misc_feature (618)..(618): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaacaaaaaaaaaacaccccggggcccctcttttgcgcgggggcgcgcggaaaaaggggtattgaagggcgccctgtggccatatagcgcgtggtctcctgtgccccaggtttctctttgttacacacggggaaaacctctgcgccggggtcccccctatattggggaggccggctaataantttccgagaataccgccgcggttaccccgggattaaattgcgccccgcggcacaaaaggtcccacgcgaactatccgcacacacgccgacacgcagcccggcttttaaaccacagacccaacaccgacatatcaaacacccgc

SEQ ID NO: 360429 - DNA, 449 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaagttttttttttttttttttttgaga

SEQ ID NO: 360430 - DNA, 724 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaatggctcattgcaagctccacctcccagcttcaagtgattttcctgcctcagcctcctgagtagctgggactacaggcgcccgccaccacgctcagctaatttttttgtatttttagtagagacggggtttcaccctgttagccaggatggtcttgatctcctgacctcgtgatccacctgcctcggcctcccaaagtgctgggattacaggcgtgagccaccacgcccggcctgtttttttttttgaacagatgctcgactgatgatggggtcaggttttttttttttttttttttgaga

SEQ ID NO: 360431 - DNA, 637 bp, Homo sapiens
  misc_feature (564)..(564): n is a, c, g, or t
  misc_feature (601)..(601): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaatcctagttcctcagtcccgcccagcttctctcgaaagtcactctaattttcattgattcaagtgctctaagttgccattgcttatcctattatactgggatattccgttacccttggcattgctgatcttcagtctgctncttgccattttaggtaatgcatcaatcccattgctgngatctaggacgattcttactcggacctgaagtggtg

SEQ ID NO: 360432 - DNA, 688 bp, Homo sapiens
  misc_feature (463)..(464): n is a, c, g, or t
  misc_feature (471)..(471): n is a, c, g, or t
  misc_feature (476)..(476): n is a, c, g, or t
  misc_feature (503)..(503): n is a, c, g, or t
  misc_feature (525)..(525): n is a, c, g, or t
  misc_feature (540)..(540): n is a, c, g, or t
  misc_feature (544)..(544): n is a, c, g, or t
  misc_feature (596)..(596): n is a, c, g, or t
  misc_feature (601)..(601): n is a, c, g, or t
gaattcactagtaatgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaactcggagactagtttcttcttcttctcttctctcgtcttactttccctccgggtttccccgccgccgccgccgccatcagtgggggannatcgggncactngcaggccgggcagggcgggcaaccaantcgggcgcaagtttggggaggngatcagcgatgagcncggnttcgaccccaggggcacctaccagggggacagcgacctgcagtgggaacgcntcaangtgtctacaatggggccaccgggggcaagtacgtgccccgcgccggctcgtggatctggagccggcacatggactcgcgcgcccggg

SEQ ID NO: 360433 - DNA, 544 bp, Homo sapiens
ggactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360434 - DNA, 1029 bp, Homo sapiens
ggactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgctttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaa

SEQ ID NO: 360435 - DNA, 503 bp, Homo sapiens
  misc_feature (16)..(16): n is a, c, g, or t
  misc_feature (24)..(24): n is a, c, g, or t
tactaaattcgcgggngctgcttnttttctctctcgcgcgcggtgtggtggcagcaggcgcagcccagcctcgaaatgcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgctttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaa

SEQ ID NO: 360436 - DNA, 333 bp, Homo sapiens
cttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaatgcaggttcattctgtgtctgtaggcccagggttgaggttttgctgtcagtgggtgacgggtggggtagggtacccagttagttgaaaggagacaagctgtgaaacatatt

SEQ ID NO: 360437 - DNA, 489 bp, Homo sapiens
ccgcccccccccctctcaaaaaaaaaaagctataccatgcttacgcaaagtaataatcgaaaaaccactgcgaaacctgatacgcctacaataaccataccaaaataaaaaaagctgccgcctactactactaaattcgcggccgcgtcgacagcagacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360438 - DNA, 953 bp, Homo sapiens
cagttgtcaaatgatcctttattgaaatgttttcctttgtgcttaactggctgggcattccacagcaccactgttgatgtcatcgatgatgtcatgaggatggcggccatcaacattacagcccactgactgggcagtccccaggatctctttaatggttccagagagttctctggctaaggatcggtgccgcatctgtcgagcaatgttgacaatctcatcaaaagtgatattcccactgtgtttaatgtttttctgtttctttctgtctcttggtggttccttgagggctttgatgatcagggcagaggcagaaggcaccacctcaatctgggcctgtctgttctgaatggtcagtttcactgtaatcctcaggcccttccagtcacccgttgccttggcaatgtcatcaccaactttttttggagacagacccagggggccgatcttgggggccagggcagaagtggcaccgacttcacctccggtgcacctcaggtatacgactttgatctcgttggggtcgaacttcggcggcatggtggaggcggctggtgtcggatgaacccggattcgggacgaccgaaggaagttgcaccttggcctcctccgagccgggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360439 - DNA, 372 bp, Homo sapiens
  misc_feature (2)..(2): n is a, c, g, or t
  misc_feature (7)..(7): n is a, c, g, or t
ancggcncctactactactaaataagcggccgctcgaccagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360440 - DNA, 354 bp, Homo sapiens
caccctctgccgaattcggcacgcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360441 - DNA, 403 bp, Homo sapiens
aagcatggtatcaacgcagagtgcccattacggccgggcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360442 - DNA, 503 bp, Homo sapiens
gcggcgcgggcttcgggctcagggctggggctggggcgggagtgggggcttggacgcgggggacggggtgcggggtgctgggtgcggctggggccgtgaccctaggggccggtttgcgccgggagccggggcacggttccggccgtactcacggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360443 - DNA, 374 bp, Homo sapiens
tgaggccacaacaatggctaggtcgaggctggtgtgttggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaa

SEQ ID NO: 360444 - DNA, 1228 bp, Homo sapiens
  misc_feature (915)..(915): n is a, c, g, or t
ggaggaatgtcgcccattactcctcaggcctggccctcgggcctccgtgatgggagccccccaggaggggtcagatgctggaaggggccgctttctggggagtgaggtgagacatagcggcccgggcgctgccttcactcctggagtgagtttccatttccagctggaatctgcagccacccccatttcctgttttccattcccccgttctggccgcgccccactgcccacctgaaggggtggtttccagccctccggagagtgggcttggccctaggccctccagctcagccagaaaaagcccagaaacccaggtgctggaccaggccctcagggaggggaccctgcggctagagtgggctaggccctggctttgcccgtcagatttgaacgaatgtgtgtcccttgagcccaaggagagcggcaggaggggtgggaccaggctgggaggacagagccagcagctgccatgccctcctgctcctcctgacctttggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaaaaaaaaaaaaaaaaaaaaaaaaaaaaaaaaaaaaaaaaaaaaaaagaacaaaaaaaaaaaaaaaaaaanaaaaaaaagagaagaaaaaaaaaaaaaagcacaaaaaaaaaagagagggggggaggagagtgagaagtatatcctgctgtggggggagaagactaaacaaggaggcgagagcagattttttgtgaatcacggggcggcccaccccgaaacgagggcggagtataaaaagcgaacaagcagggcgggagagaataatacaaagggggatgggaggagaagaaagaaaaaagagagacgaaaggaggaagaagagacggaggaaaaaacagtggggaggagaaagaaaggaaagagaacacaagcaacacaaaga

SEQ ID NO: 360445 - DNA, 1181 bp, Homo sapiens
  misc_feature (989)..(989): n is a, c, g, or t
  misc_feature (1006)..(1007): n is a, c, g, or t
  misc_feature (1009)..(1009): n is a, c, g, or t
  misc_feature (1031)..(1031): n is a, c, g, or t
  misc_feature (1033)..(1033): n is a, c, g, or t
  misc_feature (1039)..(1039): n is a, c, g, or t
cagttgtcaaatgatcctttattgaaatgttttcctttgtgcttaactggctgggcattccacagcaccactgttgatgtcatcgatgatgtcatgaggatggcggccatcaacattacagcccactgactgggcagtccccaggatctctttaatggttccagagagttctctggctaaggatcggtgccgcatctgtcgagcaatgttgacaatctcatcaaaagtgatattcccactgtgtttaatgtttttctgtttctttctgtctcttggtggttccttgagggctttgatgatcagggcagaggcagaaggcaccacctcaatctgggcctgtctgttctgaatggtcagtttcactgtaatcctcaggcccttccagtcacccgttgccttggcaatgtcatcaccaactttttttggagacagacccagggggccgatcttgggggccagggcagaagtggcaccgacttcacctccggtgcacctcaggtatacgactttgatctcgttggggtcgaacttcggcggcatggtggaggcggctggtgtcggatgaacccggattcgggacgaccgaaggaagttgcaccttggcctcctccgagccgggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaacaaaaaaaaaaaaaaaaaaanaaaaacaacgggggggnntnttgggggggggggaaaaagggngnaaaganaagggcgacagtgggccaaagggggtttcccagagccccagtttttctgtgtgtacaagggggggaaatcggaggggcccccccaaagggacgcggaaatattgcagaaaacccgggtacccggctttgccccgccaaaggc

SEQ ID NO: 360446 - DNA, 394 bp, Homo sapiens
  misc_feature (375)..(375): n is a, c, g, or t
gccgcagtggtgctggattcggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaagtcgacgcggccgngaatttagtagtagtagtc

SEQ ID NO: 360447 - DNA, 420 bp, Homo sapiens
  misc_feature (16)..(16): n is a, c, g, or t
  misc_feature (24)..(24): n is a, c, g, or t
  misc_feature (401)..(401): n is a, c, g, or t
tactaaattcgcgggngctgcttnttttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaagtcgacgcggccgngaatttagtagtagtagtc

SEQ ID NO: 360448 - DNA, 879 bp, Homo sapiens
  misc_feature (8)..(8): n is a, c, g, or t
  misc_feature (14)..(14): n is a, c, g, or t
  misc_feature (43)..(43): n is a, c, g, or t
  misc_feature (45)..(45): n is a, c, g, or t
  misc_feature (47)..(49): n is a, c, g, or t
ggcacganctcgtncaattcggcagaggattcggcacgagatncngnnngagcaggcgcaccacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgctttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaa

SEQ ID NO: 360449 - DNA, 303 bp, Homo sapiens
ggactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgagggtgagtcagatgattccattctccgattggccaaggccgatggcatcgtctcaaagaacttttgactggagagaatcacagatgtggaatatttgtcataaataaataatgaaaacctaaaaa

SEQ ID NO: 360450 - DNA, 751 bp, Homo sapiens
  misc_feature (526)..(527): n is a, c, g, or t
  misc_feature (534)..(534): n is a, c, g, or t
  misc_feature (539)..(539): n is a, c, g, or t
  misc_feature (566)..(566): n is a, c, g, or t
  misc_feature (588)..(588): n is a, c, g, or t
  misc_feature (603)..(603): n is a, c, g, or t
  misc_feature (607)..(607): n is a, c, g, or t
  misc_feature (659)..(659): n is a, c, g, or t
  misc_feature (664)..(664): n is a, c, g, or t
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaactcggagactagtttcttcttcttctcttctctcgtcttactttccctccgggtttccccgccgccgccgccgccatcagtgggggannatcgggncactngcaggccgggcagggcgggcaaccaantcgggcgcaagtttggggaggngatcagcgatgagcncggnttcgaccccaggggcacctaccagggggacagcgacctgcagtgggaacgcntcaangtgtctacaatggggccaccgggggcaagtacgtgccccgcgccggctcgtggatctggagccggcacatggactcgcgcgcccggg

SEQ ID NO: 360451 - DNA, 611 bp, Homo sapiens
  misc_feature (12)..(13): n is a, c, g, or t
  misc_feature (18)..(18): n is a, c, g, or t
  misc_feature (20)..(23): n is a, c, g, or t
  misc_feature (29)..(31): n is a, c, g, or t
  misc_feature (419)..(419): n is a, c, g, or t
  misc_feature (436)..(437): n is a, c, g, or t
  misc_feature (439)..(439): n is a, c, g, or t
  misc_feature (461)..(461): n is a, c, g, or t
  misc_feature (463)..(463): n is a, c, g, or t
  misc_feature (469)..(469): n is a, c, g, or t
tgccgggtgacnnagctncnnnngttctnnntcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacctaaaaaaaaaaaaaaaaaaaacaaaaaaaaaaaaaaaaaaanaaaaacaacgggggggnntnttgggggggggggaaaaagggngnaaaganaagggcgacagtgggccaaagggggtttcccagagccccagtttttctgtgtgtacaagggggggaaatcggaggggcccccccaaagggacgcggaaatattgcagaaaacccgggtacccggctttgccccgccaaaggc

SEQ ID NO: 360452 - DNA, 434 bp, Homo sapiens
ctcgccgaggcccctccttgcccgccgatatctctgccgggtgactagctgcttcctttctctctcgcgcgcggtgtggtggcagcaggcgcacaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggatcgcgaccgacctggattcgcgaccgaacctggattcgcgaccgaacctggattcgcgagcga

SEQ ID NO: 360453 - DNA, 860 bp, Homo sapiens
ggactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgctttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctaaaaa

SEQ ID NO: 360454 - DNA, 261 bp, Homo sapiens
ctaactctagactcaaccaactccagaccgccctgcaaaagaccgggtggctctacaaaagtccgtgatcaccagcaactcaaagcatacgcgctgcggacagccaaggtcatattaggactatctcagtatagaaaggatgattggtgctgttaaagcttcaggggtgcagaggtctgttacatggcattgtgaccataactaagaataatgtgtatttaaacattactaaaagaatagattttaaactttctcatcata

SEQ ID NO: 360455 - DNA, 611 bp, Homo sapiens
taaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgagcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatataca

SEQ ID NO: 360456 - DNA, 5748 bp, Homo sapiens
  misc_feature (524)..(524): n is a, c, g, or t
  misc_feature (2226)..(2226): n is a, c, g, or t
  misc_feature (2569)..(2569): n is a, c, g, or t
  misc_feature (2895)..(2895): n is a, c, g, or t
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtgaggggggccgggtctgggaggcggcctggggagcccccaacttntgcgcggtggaatccagccggggggacggcgttccccagtcgcccccactttctggaaggggggctggactctggagaatgggtcaggggctcctggcttcccgccgcagaatgggaactcgtgatcgcagacttgaccccgcttgactggtccttggagtttgggtgggagggagactttccccaactcttcagatccgtctccggccctgaaccagctccagccctctgctctcctcagcccactaaaaggggggtgctcctgggccagagtgattgctcagggagtgctggggagaatgaggggttcccatctcccacagccacaaacgcatttctcaaaatggagcctccacttgcccctccttctctttcgggctccaagagcgggagccggcctggctgggcctggctttccagactcctggctctggctccctggatgtgtggctctcagggcccggctctgtggcactttggacttatgggccctcggctccgtggggttggggggccctggctcactgggtcccgctggctgtccccttgtcggcctgaccctcgggcctctccgagtctttgtctcttttgggtccctgtctttctctgagcctgtctccttccttcaattttcactttctccgtgctcgctgaagtggggaaatgcaacagaggtgccagcccccttggccccctaagaagtcccttccccactgttcactccacaccctggagtgggcccagagaggggaggggagggggttctctatctgctctgctgggggctggggtgtgtggggtggtctgagccccagccctacagaggggcctgtggtcactccctgctcctggcctacccctcccccagctccccgcagctcctgccccagcgtggacacctcttcctggttcgcagtgtcttttgacttgggtgggaaggagggcggtggatttaatggagggcatgcgagaaagaaggggaacagatcaggcaaaggagttagataatgtcccacctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcncttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360457 - DNA, 2849 bp, Homo sapiens
cccagagttcggaacctagagttcggagccggctagggagccggcgttgtcgcggcgaggaggtgggcgcgctggagcaggagcggggccggaagctggagccgaggcgcaggtggcgctgggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360458 - DNA, 3204 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360459 - DNA, 4419 bp, Homo sapiens
  misc_feature (897)..(897): n is a, c, g, or t
  misc_feature (1240)..(1240): n is a, c, g, or t
  misc_feature (1566)..(1566): n is a, c, g, or t
aaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcncttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360460 - DNA, 2781 bp, Homo sapiens
acctactctagggagggggctgtgctggttctgcctgggcagccccacgctgaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360461 - DNA, 2112 bp, Homo sapiens
gctgggattacaggcgtgagccactgcacccggccaagtgcttgctttttttattttttgagacaaggtctcattctgtcacccaggctagagagcagtggcgtgatttcagctccctgtagcctcaaccccctgggctcaagcagtcctctcaccccagcctcccaagtagctgagactacaggcgcatgccaccacaccaagctaatttttggtctttggagaggcagggttttgctgtgttgcctaggctggtctcgaactccggagcttaagtgatccacccacctcgcgtgagccaccgagcccggtctgcttgctcttgtgtttgtttctatgatcatcataaaagcagttagtattgttgttgcaattactattgttgtttaatggaatccacccttcctgagccctcggaagtgggctgccagagcagacactgagtggggagttgggaaaactgcccaggagccaggtctctcttctcgcctgcaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360462 - DNA, 2953 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagtgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360463 - DNA, 3576 bp, Homo sapiens
  misc_feature (897)..(897): n is a, c, g, or t
  misc_feature (1240)..(1240): n is a, c, g, or t
  misc_feature (1566)..(1566): n is a, c, g, or t
aaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcncttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360464 - DNA, 3267 bp, Homo sapiens
  misc_feature (897)..(897): n is a, c, g, or t
  misc_feature (1240)..(1240): n is a, c, g, or t
  misc_feature (1566)..(1566): n is a, c, g, or t
aaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcncttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcactgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360465 - DNA, 1744 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacaccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360466 - DNA, 2661 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360467 - DNA, 813 bp, Homo sapiens
gctgggattacaggcgtgagccactgcacccggccaagtgcttgctttttttattttttgagacaaggtctcattctgtcacccaggctagagagcagtggcgtgatttcagctccctgtagcctcaaccccctgggctcaagcagtcctctcaccccagcctcccaagtagctgagactacaggcgcatgccaccacaccaagctaatttttggtctttggagaggcagggttttgctgtgttgcctaggctggtctcgaactccggagcttaagtgatccacccacctcgcgtgagccaccgagcccggtctgcttgctcttgtgtttgtttctatgatcatcataaaagcagttagtattgttgttgcaattactattgttgtttaatggaatccacccttcccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360468 - DNA, 1990 bp, Homo sapiens
  misc_feature (897)..(897): n is a, c, g, or t
  misc_feature (1240)..(1240): n is a, c, g, or t
  misc_feature (1566)..(1566): n is a, c, g, or t
aaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcnacaactacatccagatgtaccggcgcaaccggcagctagagcaggagccccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360469 - DNA, 3033 bp, Homo sapiens
  misc_feature (897)..(897): n is a, c, g, or t
  misc_feature (1240)..(1240): n is a, c, g, or t
  misc_feature (1566)..(1566): n is a, c, g, or t
aaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcngggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttcnctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcncttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360470 - DNA, 808 bp, Homo sapiens
cccagagttcggaacctagagttcggagccggctagggagccggcgttgtcgcggcgaggaggtgggcgcgctggagcaggagcggggccggaagctggagccgaggcgcaggtggcgctgggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagagaaggtgaggaccggctcttccttgtgggcctgggtagaacgggagtcctcgcttgggaaactggaatttagaagcttatatagaggaaagagtgtgggctccagattcaccagacctgggtcctaatcccagctctctctcattctggatgtgtgacctcagggaagtcacttaacctgagcctcagtttctagaactgacatgaaggtcaaataatgtatagcatagtgccta

SEQ ID NO: 360471 - DNA, 2792 bp, Homo sapiens
gccagaggagggggctctgctggggagaggggctcagtctgttcttgtgaggctgagggtctggggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360472 - DNA, 2979 bp, Homo sapiens
ctgtgaatagaggctgtcaatgcgtgaaagatggttaggagactaagtgcacttgagactgtgactgggtgcgaaggactgcggattgttgtggaagcctgtgcccaacaggcctgtgacaccgtgtctgtgtgtgaggtggactggaagattatggaaagaaggaacgcggacccacgtgacggctgagactgcggctgcatgtgggaaaggtcttgtgggtgttagggagactgtattgtgtgcgagaaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360473 - DNA, 3145 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagccaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360474 - DNA, 3072 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360475 - DNA, 1995 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccagccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360476 - DNA, 1899 bp, Homo sapiens
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaaaaaaaaaaaa

SEQ ID NO: 360477 - DNA, 594 bp, Homo sapiens
aatctgtagtccctaatgtagccttttgctatctgacatctgtttgacatatgctttgtcaaattgattcaactcaaacttgaatacttatgttttgccaaatttgtgtgatcacattgtgttactaatgtgtaacatcagcctgtaacttcagccacctactttttatttgtggatgctgcttagaaacttgcaaataacactatgaatatgtggagttccttgactgtccactctgttgtccctttagagagtacattacatgcacatttcttgtgtattttctagttcaattagaattcctccgttctttccagccaattataaaggttttaaaggaactattcaatgcaatgtatttccataagtttagtacctatgtactttctcttgggagtggggagttggcgaggggagtcatgaatttttggcaatgttaagtagtatcttattgcccatatttttcgcatgtctaaatgccaaattttgtgatgtattttgcacaaataactcattactctgaatcttaagtagtgctttatttgccctcacaatgttgccctttataaattgataaatttatgaaaaaagaaa

SEQ ID NO: 360478 - DNA, 490 bp, Homo sapiens
tagaaggctagatgtaccctctcctgggaggcaggggagatgggcggtggactgaataatggcccctctacatcctagtccccccgaacctgatgtttccttatatggtaaaagggactttgctgaatgtaattatattagggttcttgtgatggggtgattatcctggtttatcctggaatgcgggagggcctgtgatgatggaagcagagactggagatctttgaaggtggaagaaggggctgccagccaaggcggctattagaagctgaaaaagacacggaaatataatagattctttcctcagggcctccaggaggaaccagctctgccatccctggacttaagcccagtggaactgatttcacacttctggcctccagaattttaagagaataaatgtggctgggcgtgggggctcatgcctgtaatcccagcactttgggaggtcgaggcagatggatcacttgaggtcaggaatccgagacta

SEQ ID NO: 360479 - DNA, 557 bp, Homo sapiens
attgcttatattataattgggtctgggtccaaatatatattgaacttattttccaaaagaaatactctccttagattgtggcatggcaggaaagcatactgttcctagtagtcctctccaaactcctttaaaaactgagctttatggcaaatttgtaatgaagatgtaacactttcactacttaaaccatgacttcaatttgtgatataattaagggcaattactcctgttagagattgtagactaggttaggctgagttaataaatagctgtttggctctggcattagcaaggatgtcttcattagggtagtaatgtgtcaagagtgctaaataggttgccatggtatttgtgggtttcagcctggactctggctttccctgaaattaaaaatgttcagcctttaataaaaggcacttccttacacagcaaagcagacagaacactaaataggtgaaatgaccagggctcaggaacttgattgcagaggctgatgaatacacacgtggatattttaaagtaagcattgactctgacaggctttgttaaaaaaaaaa

SEQ ID NO: 360480 - DNA, 1576 bp, Homo sapiens
ctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggttaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgacagagactccatttaaaaaa

SEQ ID NO: 360481 - DNA, 651 bp, Homo sapiens
ctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgacagagactccatttaaaaaa

SEQ ID NO: 360482 - DNA, 1341 bp, Homo sapiens
ctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggttaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgccctctctctctctcctttctaatggtcacttctatcaagatgatcttccagctgcagttatggatcttggc

SEQ ID NO: 360483 - DNA, 338 bp, Homo sapiens
tttaagcagatctaagcccgttttaggtagaaatgcattcctcttcttggggctgcaacaggaaattctaaaaaccctttgtggaggtgcatcttccgtgaagttaaaggttccaggcccagccttccagccacgtggttcagggttagtagctgatacttctgtggaaaccttgtccataaagggtcagttagcaccaggggaggggcctggcaagaggtgaaactccaagcacatctattaattatgagagagaacaacatgtttttattttgctgttcatttaaactggaactgagaaaggttgctgggtccccacacattatcttcctcctccc

SEQ ID NO: 360484 - DNA, 393 bp, Homo sapiens
gacttacattttggagtaaataaaaggttatactgtattttagttaaaagtattccttttcagtgttaggaggcatggttgatttgtgaaataactttacaagattatttttataactataagtagaccattacttatttttaaagaaccagcatttaaaaaatgtgtgaaattgctttaactgtgaatactgttatatctagtaaataaagttattctatgaattttccagatggtgatagcaactagaataatttgattcatcatttctgtctcattcatgatattaatgaattgtgaataagtacaattaaaatctgcactggattgtcccatataagactctacaggcttggtgtttcttaaatgagaaatatcagtatatatttttag

SEQ ID NO: 360485 - DNA, 703 bp, Homo sapiens
aaagaaggaacggacgcacacctccccaaggagccctggcactaactacaacacacacagggtttggccagacctggaccagcttttggaaaacactaactcaactgtcatccaacttgctgcagttaaccacccgtcagtcacccatcagggggcatgaagctctggtttgatcactttgctaagggctgcacaaggaagaaaaaaagtcataaaacactatattgtcaagcagtactcactgcttctcctcttcactgtcctctaccttgagtccctcaaaatatttcacctgcatgacatttcttcacttgagatgctgtttgccctttaaatggcatcttagcatttgaggtcctctagctgtcttctttcttttccttaggctgacaattctgctgaaagtttgtgaaaagacttgacattcacaaaatctaaggtcttctggtgataccaaatgtaacaggaatggaagcatcatcagcactgtgcaacattatgtttctttagcatggtttggctcaggttacaaaacctgggcagctgtaccacagacagaggctatggccatttcccctctattttatgatcatccctgtttcattactttgtgctttcactacatcctggcctagcagtctgtagcagcaggctagagagataaggccttctggtaataaataaagtagaaggttaaaaccac

SEQ ID NO: 360486 - DNA, 439 bp, Homo sapiens
gaatggaagctctaccaaaaagaagatacattaaaatgcttcacccccggagtaactgctcctagagtggcagctgtgtctgggagtgggatgctcctcccacagacaagcagcagaagagccacttacacagaacctacaagggagcagcccatcagtgaaatgggcccacacaatttcagagaagctctgagtaccagctgtccaagctaatcgatgcactctgtcattcacaaatatgaacagataacctaggaacacttgaaactaaggaaaatgagcagcatggaagagaaggaccaaagggaacaaacagaataactaacttcagaagaaacgtataatttagggaacaaaaggaacttctgaaaacctcacatcaatatccttagaaaaatctgagaaaatatagtatccataaaacaaaaaaagtgatatg

SEQ ID NO: 360487 - DNA, 216 bp, Homo sapiens
gctagcaacccgacaaaatattttctgatggtttttcgtgtatgtggtttttgtttttgagggagagaataattaacaccttggttaaattgtactgagatacaatggctgtttttaaaaattgctgttaactgaagggttgaagctagtataattcccaggctcagcctcttgggaggctgagtctccaatagcatagtcttcaatagactatgc

SEQ ID NO: 360488 - DNA, 306 bp, Homo sapiens
  misc_feature (68)..(68): n is a, c, g, or t
  misc_feature (72)..(73): n is a, c, g, or t
  misc_feature (75)..(75): n is a, c, g, or t
  misc_feature (78)..(79): n is a, c, g, or t
  misc_feature (84)..(84): n is a, c, g, or t
  misc_feature (92)..(92): n is a, c, g, or t
  misc_feature (113)..(113): n is a, c, g, or t
  misc_feature (116)..(116): n is a, c, g, or t
ccccctccccgggtatctaatcccagttggggtcttagctattgtgtgttcagatatgttaaagccantttnntngtnnatttngtgtcaantggagttttttacaactcagntgngttttagctttattggggagggggtgatctaaaacactctttacgccggtttctattgacttgggttaatcgtgtgaccgcggtggctggcacgaaattgaccaaccctggggttagtatagcttagttaaactttcgtttattgctaaaggttaatcactgctgtttcccgtgggggtgtggctaggct

SEQ ID NO: 360489 - DNA, 587 bp, Homo sapiens
gacttgaactccttcctcggctgaagtgatcctcctgcctcagcgtcctgaataggaagtggagccagaatccacagatgtcattatccatctgcacactttgtttactacccagaaggcaagaatattgcattttaaaagtgcccggacttttgttctttcttatcacaaatgacttgggaagctccgaccactcatgtttaccccgagtgaaagtcccattcaaagccttgcttcctggagagctttgagattctggtacaaaaggcattttataagcacaaagtggaaaagcatcattcatattcatttgctgctgcggcatttctccctggaatcttcctcttgtctgtcaacattgggcaaaaggactggcctcatctacattacagatatccttgtgatggtctggaggtaggaaaaggacacccagcacaagagtgagaagggaaactcaagctctcctgttggagagtctcaggcttctttatccataaaactgattggacataattggtgtgggtttatgatttgttttggaaaaacctgagtatgaaatcaatactgtgctttgtgcaaaatggctg

SEQ ID NO: 360490 - DNA, 738 bp, Homo sapiens
taaattaatgttgagttatgttctgtttattatcctgtttgccttacgtttcctgtcgttttccagttgtctgcttgaattctgtttttcaatagtgatttagcaactgataatgtatattgatttcagttttgcttctaatttacatttgtatctgtttggttgatgtatttggcttaatcattttatttttataagcagttgtacaatttgttaatttagctagatgattaaatttggcttctaaagagtttgttttagaaaatagtccctgaagtaaattagtgtttggcatttccaacatgtcaaaggagctggtctcttaaagataactagaaatgtaactctgaattcttaaaagtggttttgtaattttaaacctctgactatatggagctgtatattccagtaggtggtgcaaatcgactccatttcaaatggaaatgtaatttaaacttgtgatgtaactgttttcactgtaaaaataatatttcaacatgtttcgcaactgcaaaattattttcctctctttctaaaggaagcttgatttaccctctcaatgctcatttttcttatggtttattcctcaggtatcattctgatcattgttgttacaggagagatgagaggaagttagaggggctagaagaaccaggagacctgttgaaaatcatgaatacaaagagaggtcgtttgcttctgtgcttcaattctataataaaatgagtacaacgtcag

SEQ ID NO: 360491 - DNA, 713 bp, Homo sapiens
gacttgaactccttcctcggctgaagtgatcctcctgcctcagcgtcctgaataggaagtggagccagaatccacagatgtcattatccatctgcacactttgtttactacccagaaggcaagaatattgcattttaaaagtgcccggacttttgttctttcttatcacaaatgacttgggaagctccgaccactcatgtttaccccgagtgaaagtcccattcaaagccttgcttcctggagagctttgagattctggtacaaaaggcattttataagcacaaagtggaaaagcatcattcatattcatttgctgctgcggcatttctccctggaatcttcctcttgtctgtcaacattgggcaaaaggactggcctcatctacattacagatatccttgtgatggtctggagggacctgtgggagaggcggccatccagagggctctctgaggggtcatttagaatgcaactcttctgggcagaggatggtctgcactggcctccaccacgcaggaaggcttccagagtggagaaatgtccactaacatggcttctgtgaggtcatgtgctgggtgctgggaacacaaaggagagatgagaggaagttagaggggctagaagaaccaggagacctgttgaaaatcatgaatacaaagagaggtcgtttgcttctgtgcttcaattctataataaaatgagtacaacgtcag

SEQ ID NO: 360492 - DNA, 2838 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360493 - DNA, 992 bp, Homo sapiens
tccagtgctccaagacatctgaaacattgtttaatttctgtgtatttgtatagggtccaaaactatccttgctattaatttctatttttattccattgtggccagagaatatgcttgatattatttcaatttttttttttttttttttttttgaaacagggagcagctctgtcacataggcttcttttttgctttgggtacagggtctcattttgtcacccaggctggagtgcagtgacatgatcatggctcactgtagcctcaacctactgagctcaagcaatcctcctgccttggcctccctagtagctaggaatacaggcatgtgccaccatgcccagctaattttttaaaatcttcgtagagatgggggtcttgctgttttgtccaggctggtgtcaaactcctggcctcaagagattctgccgcttcagccttccaaattgctgggattagagacgagtcaccacacctggaccatagtctttaaagtcactacataaattccatcgtatagaaatactgcagtttatatagccttgcctctattttattactaagtcattggttatatatttcattgtctctctgatctaattttttaggacagtgcttctcaaacattaatgtacatgtgaatcacctgggagtactgttaacacagatctgatttagtagtttgggatgggacctaagagtctgcattttccaggaaactccaggacaatgctgatgctgctggtctatgtatcaacattaaatccttttacgtgtattaagacaagtagttggaaggcttcaattttcttaaatactgatttattgtgatgaattaattttgaatggttgtttcatatttattgagggttttttttaatgagcctagtatatggccagtctttttttttttttaattaaaactgataaacatttaaacaaacgtacctttctagcttctgaatattttatcttgtttgtacctacactgtctg

SEQ ID NO: 360494 - DNA, 672 bp, Homo sapiens
  misc_feature (6)..(6): n is a, c, g, or t
acctanaggatcccctcgaatcgacggtttctctctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatctcttgcagcctcatttgaggtaaagcaatgtttctctcctgccctgttgcatgtgactctaaacttcagcacttgaggctcagtttcttcttttgagctttcatcagtctcatctttgcaagatgccaaatcatcacctattaatgttgatacatcctcattgatggctggattttcataataatctaagatatgagaatctaaagcatggtaagtgaactctttttaacattctctgat

SEQ ID NO: 360495 - DNA, 3444 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcagccggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggtattctgtactcaattaagttattttgagtcacagaccttttgaaaatctcgtgtaagctatggcccctccacctctctaatacttcccccggcccccaccccaagcacacacaaaagcttatgcataggaaatttgttttactatttcggattacttccaagatctctctcctgatgcccatctatggatcccagagtctggacaagacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360496 - DNA, 2352 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcaccatgttggccaggctagtctcgaactcctgacctcaggagatccgcccacctcggcttcccaaagtgctgggattacaggcatgagccactgcgctagccgtcaatttcttaacaagcatgaaaggggttcatcttgtttggtcttgactgcgtcagatggtggaaatggttgtgtatgtcatgcttttggtgccaatgcttcctgtgcattaccttatgcagagaacaagtagcaactaaatatgtggtgtaagggtaataactaaaacattttggttcggaactgtta

SEQ ID NO: 360497 - DNA, 3236 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcagccggatctcgtggcggagcccatcttgctccctctcccaggcctttacccgctccctaggattcccgggccctgtaggtgggagttgggagacgtgagttctctttcattctgcgcctctcattggctctctgaccttgtgcggaacgcgtcctttagctgacctcagctgcattttttagaagatggagattgtattcacagtgactgtcagctttttaacggcgggaactgacgtagtgttaaacactgtcgtgtatcgctggcacagcacaaggacattataggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360498 - DNA, 2652 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcagcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360499 - DNA, 2473 bp, Homo sapiens
  misc_feature (6)..(6): n is a, c, g, or t
acctanaggatcccctcgaatcgacggtttctctctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360500 - DNA, 2769 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaagacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360501 - DNA, 2548 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaagggtaaaaatttaaaagatttcttagcatcttttagttagagaatcactttttatattgactttatgaattaaaactcccagtgcattgtgacgtcattgtaaccaaaatgaatatactatgagactccatttacatttttaaagtttattgaaaataagttatatttttaaaatattattttagcgataatttccccaccatatgcaatttttcatttgtcttattcatatgtcttttcccctacatattggaagaatattttatagactcattttaatttcacaaaattttaaacagtatatttttacataggcttcttttttgctttgggtacagggtctcattttgtcacccaggctggagtgcagtgacatgatcatggctcactgtagcctcaacctactgagctcaagcaatcctcctgccttggcctccctagtagctaggaatacaggcatgtgccaccatgcccagctaattttttaaaatcttcgtagagatgggggtcttgctgttttgtccaggctggtgtcaaactcctggcctcaagagattctgccgcttcagccttccaaattgctgggattagagacgagtcaccacacctggaccatagtctttaaagtcactacataaattccatcgtatagaaatactgcagtttatatagccttgcctctattttattactaagtcattggttatatatttcattgtctctctgatctaattttttaggacagtgcttctcaaacattaatgtacatgtgaatcacctgggagtactgttaacacagatctgatttagtagtttgggatgggacctaagagtctgcattttccaggaaactccaggacaatgctgatgctgctggtctatgtatcaacattaaatccttttacgtgtattaagacaagtagttggaaggcttcaattttcttaaatactgatttattgtgatgaattaattttgaatggttgtttcatatttattgagggttttttttaatgagcctagtatatggccagtctttttttttttttaattaaaactgataaacatttaaacaaacgtacctttctagcttctgaatattttatcttgtttgtacctacactgtctg

SEQ ID NO: 360502 - DNA, 305 bp, Homo sapiens
aaactagggagatgggacattttaaaaatacaaaatatagttagtagctgctttaaaactatcattcctaattttttaaatacttaattgttgatagcttgtgctgttcaaaagctttctcagaaatgtgtttctttttttttcacccagttcattgtctgagatcagttgataacttatttgtggtggttcaggagtttcaagattaccagttcaaacaaacaaaggtgagctatcctaaacatggtggctgatttttggctgtcttccacaaagagattatttccatttttcatagtctgtga

SEQ ID NO: 360503 - DNA, 183 bp, Homo sapiens
gttttaacatacactcttatcttttagggggccactgaatggtctgactgcttccatattgctggtgataataatccactggctgtgaatagagcagcaaataacattgcatctttattgaccaagagccaaattaaagaagggtaaaaatttaaaagatttcttagcatcttttagttagag

SEQ ID NO: 360504 - DNA, 286 bp, Homo sapiens
cagaattctaagcagtttactaactcaacttatttcatagacatgtaatggcaaaggtctggtttctaaaactacagctatttttcatgcctcaggatgcatgaaactgtttttgtttcatatagtccttctattttgtatcttttgcaagtgtttgactcatgagaccttctattataggatgggatccaagaagagaaactggaacctttatccagcttgcctacgggagatgagccgtgtctgcacacctaccacaggccgagctgtactacttactcaagac

SEQ ID NO: 360505 - DNA, 3378 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcagccggatctcgtggcggagcccatcttgctccctctcccaggcctttacccgctccctaggattcccgggccctgtaggtgggagttgggagacgacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagtacactaaggtgtgtgttttcaaaaccaaacacaaacctgtcaagagtatttgttggctagtttcttaaaaggccaagagaaaaaaaatgatatatctttggaaaacttttaatttgggagttatgtgagttgttactttctcctggatcacgattcacatttaattgcttttccagttgcaacaagtccttcttgagagttttgtggaaaatggtgcttccctgtagtcccagttatgcaggaggctgagactacaggcgcccaccaccatgcccagctaatttttcgtatttttagtagagacggggtttcaccatgttagccaggatggtctcg

SEQ ID NO: 360506 - DNA, 2850 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaactttattgggaaaccgcccatccttgggtaggggggggggggcccccccccacccaattggaaaaaattttttgtttctccaaaccccgtgggtg

SEQ ID NO: 360507 - DNA, 2627 bp, Homo sapiens
taatatttgggctttatttctttttcttttaaagggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360508 - DNA, 2722 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcaaaatcagcagagaccgtggcaagatatattttgtcatttcagtggaaagtctggcacaggttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360509 - DNA, 2984 bp, Homo sapiens
taccatggtaggacacaaggcccctgactctccgctttcagcttactgaagatcctcaaaaccaacagcacacagcttccagcgcatgctcctttccccaagaccctgtgggggaacccgccgccagcgcggagccaccgtgactcgtagcctgacttccgtttccgggggcggcttccggcggcgtgacctgaccgcaagaggccaatggagtgtgggagctgaaagggtcttcgctggcggccggtaactggcggcggttgggaacggccgagtgtggctcttctggtgtttcagcttggggagagaggggtggccttcctcttgcagttgaggccggcgccgagccggacttcagccggatctcgtggcggagcccatcttgctccctctcccaggcctttacccgctccctaggattcccgggccctgtaggtgggagttgggagacgacagtactgcttttaaagagacagtgttagggatcttggaagcacagccaacatgtgtgacattgaagaagccactaaccaactcctagatgtgaaccttcatgagaaccagaagtctgtacaagtgacagaaagtgacctcggaagtgaatctgagcttctagtcactattggagccactgtacctactggctttgagcaaacagctgcagatgaagtcagagagaaacttgggtcatcatgcagttcattgtctgagatcagttgataacttatttgtggtggttcaggagtttcaagattaccagttcaaacaaacaaaggaagaagttctaaaggattttgaagacttggctggaaaactcccatggtcaaaccccttaaaagtgtggaaaattaatgccagttttaaaaagaaaaaagcaaagcgcaaaaagataaatcagaattcaagtaaagagaagattaataatggacaagaagtcaaaatcgatcagagaaatgttaaaaaagagttcactagccatgctttagattctcatatcttagattattatgaaaatccagccatcaaagaggatgtatcaacattaataggtgatgatttggcatcttgcaaagatgagactgatgaaagctcaaaagaagaaactgagcctcaagtgctgaagtttagagtcacatgcaacagggcaggagagaaacattgctttacctcaaatgaggctgcaagagattttgggggtgctgttcaagattattttaagtggaaggccgacatgaccaactttgatgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360510 - DNA, 1829 bp, Homo sapiens
gtaaactgagggcagctgcaaatgaggggcagagatagggggtgcagtacaagagaatgtaagtggaaggccgacatgagcaacatagagtgtggaggttcttttgaacatccatgataatgaagtcattgtgggcattgcattgactgaagagagtctccaccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaagagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgtacttcccaccactggaaatgttagcataaaagaacttggagaggaaaaaagtattaacaaaactgcagtctgcactctttaaacctgtttaaggctcttcatcctggttagcaaaaggtgtgaatgtaatgtgatggaatttaaaagttttatgagaccaggcacagtggctcacgactgtaattccagcagtttaggaagccgaagtgtgcagatcacctgaggtccggagaccagcctggccaacatggtgaaaccctgtctctactagaaatacaaaaattagccaggtgtggtggcgggcgcctgtaatcccaactactcaggaggctgaggctagagaatcacttgaacccagcaggcggaggttgcggtgagtcgagatcacgccattgcactccagcctgtgcgacaagagcgaaactctgtctcaaaaagattttataagaaagcagagcttttccttgaagctcttttgaagtggtagcttaattagtattttgttgaaaatactttaaagatgcctagtgaaaagcctactaaagtgctgtgagattggggtttagaacattttattttcaggctttatggcctattttccattgtgtcaagtgcaaaactaccctggcccaaaggaagggcagagaacataattacatcttaggccacatttcattctttgcagctttgctaatccagttgctcaagttctttacctcaacctgaaggaatgaagcattattacattttgtgaatggtgttcagcctataagacgaagtctcacaagacctataggaaagtttaccatctgccttaaatattaaaatatccatctgttattcacattaatacacagaatgaaaatagaggtctaggaattatcaaaggtactgcaaaaatactgtatagaacttatttgtaaatagcacatacattgatagatggggtgtgggaccaacaaaccaaattaaaagaaattgtttttctttcagta

SEQ ID NO: 360511 - DNA, 3239 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360512 - DNA, 386 bp, Homo sapiens
gcacgagcagtggactgacgttacactggaagctgtggctatttctgtggactgacgttacactgggcttcattgttctttcatttaacaaatgtgacagggaccgggctggggacacacggggaacgacagtgggtctctgcccatgggaactcacaatctaacagcgagacgaggcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360513 - DNA, 3178 bp, Homo sapiens
ctaggtggaggccccgtctgaatcggccgagagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360514 - DNA, 3154 bp, Homo sapiens
ctaggtggaggccccgtctgaatcggccgagagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360515 - DNA, 3459 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaagctgaaaaaaacagtcaactagattgtgttccccttttgtgttgacttcttagctccgctttattagaatgtgataaaaatgagacctaagtggaaacgatcactgtccattgttttccactcttatcattactgtatccaaaatagtctttctcaatgccaaaccatagtcatttctttattaaactcctcgccaggttctccccg

SEQ ID NO: 360516 - DNA, 3276 bp, Homo sapiens
ctaggtggaggccccgtctgaatcggccgagagcggttactcactccatggctgcagcaaggagaggcggcggcggcctcggctgaagaaagaagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360517 - DNA, 3273 bp, Homo sapiens
tgattccccgctcgcgactccccaccccccagggctccctaaagagggccacgagctgcgaaagggcgggaaaggcagttggagaagaggtaaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360518 - DNA, 2602 bp, Homo sapiens
cggctaggtagcgagggctgggtgttgcaccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360519 - DNA, 2823 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatccccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360520 - DNA, 503 bp, Homo sapiens
attcaacaaagtataaagacaaatacaaaagatgcttgggatacaaccgctagcttctgccttccacacacagtggattttactgtaactgactagagttactctggtgccactaagttccgagccaagtctaccgccaccggggggagcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360521 - DNA, 626 bp, Homo sapiens
ctaggtggaggccccgtctgaatcggccgagagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagacccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360522 - DNA, 881 bp, Homo sapiens
tgattccccgctcgcgactccccaccccccagggctccctaaagagggccacgagctgcgaaagggcgggaaaggcagttggagaagaggtaaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacatggtcaggggatcagccgccaggcggccgtgcctaccagcggaaagggcgatcctttaaaaaggggtaggccg

SEQ ID NO: 360523 - DNA, 3361 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360524 - DNA, 3394 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360525 - DNA, 3151 bp, Homo sapiens
tgattccccgctcgcgactccccaccccccagggctccctaaagagggccacgagctgcgaaagggcgggaaaggcagttggagaagaggtaaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360526 - DNA, 3306 bp, Homo sapiens
tgattccccgctcgcgactccccaccccccagggctccctaaagagggccacgagctgcgaaagggcgggaaaggcagttggagaagaggtaccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360527 - DNA, 3414 bp, Homo sapiens
ctaggtggaggccccgtctgaatcggccgagagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggtccttaatgcaagtcggttatgcctgtaggttgaaaggcatcagggaggaaaatgggaccagaatgccaggtgacctaaggaggagagagagaggacagttgaaaacccacagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360528 - DNA, 3162 bp, Homo sapiens
tgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360529 - DNA, 3100 bp, Homo sapiens
ggacgcgtgggtcgacccacgcgtccgagagcgcaggcgtgaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360530 - DNA, 2226 bp, Homo sapiens
ctaggtagagctgggtgttaatcggccgaggcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360531 - DNA, 2078 bp, Homo sapiens
ccagctccgccccttgcagctggcagcgccctgcatctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttgtttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaa

SEQ ID NO: 360532 - DNA, 558 bp, Homo sapiens
ctaggtggaggccccgtctgaatcggccgagagcggttactcactccatggctgcagcaaggagaggcggcggcggcctcggctgaagaaagaaggtgggagcggagagcgcaggcgtgccgaggtggatgtccgtcttttctctgttgcagaaacccaccttgtcccatccacatcaggacatcccagctggagttcaaccttcatcccttctgtggcagttaggagactgaatcaaggtccagagaaggtggaggaatcctgatactgagcggtacacacaagcttctttctccttccttacctgttgcgggcaggaagtccttcttgggatctgaccaccttcccttagagcacttactgtccactctgccagtttttgagcacttgccctatattttcttgggcctataggggctgtgttatcactgaggcagtatacagagtagcagctaagagcatagactgagcttgtcccacccgtgggcctgcatgcggcctagaacagctttgaatgcagcctaacacaaatttgtaaaccttaccaaaacatccgaa

SEQ ID NO: 360533 - DNA, 356 bp, Homo sapiens
gtatcttgcattggtgcttttagtttctgcccataattttggaaagtttttgaccactatttctttaaacatgttctgctttgctcttttttctcctaggattacaaatgttagagaatttgctatttttcaatttgtgtttcaatttggtgatttctacgacatatcctcagggtctctaatcctttcctaggttgtgtcaagtctatcgattagccagtcaaatgaattctttttctctgttagtaaatttttatttatagcatttctagttattgttacagtttccttctctgtgctgaaattatctatgtgatcttgaatctcatctatctttatcttcagaatatttagta

SEQ ID NO: 360534 - DNA, 4242 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360535 - DNA, 4884 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360536 - DNA, 1674 bp, Homo sapiens
ctggctgttggttatcttttcttagaaataatgatataatcttttcagcacctgatattcttaaagatccagggtttacaaatgactgttagatatgccaaggatgactagcctataacttaaggatctgttcaggaacagtagaaaagaaggtgataggaaactgggaatcttaaatctaatactagttctgtcatgaattaggcttgttattgtagttgtttctcaaatttaagaaaatatgaggggtcttgaaaaagtgcatggaaaatgcatatcatgaaaaaactatgcatggatttcaaaatttttggaccaaaataaactcctactaacttgttataacatgtctgaacaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360537 - DNA, 915 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccaggtgaagctgtacttcacaaaaacagtagaggagccgtcaaatccagaggctagcagttcaacttctgtaacaccagatgttagtgacaatgaacctgatcattatagatattctgacgaccactgactctgatccagagaatgaaccttttgatgaagatcagcatacacaaattacaaaagtctgaatttttttttatcaagagggataaaacaccatgaaaatcaacttgaataacctgaaaatggaccttttttttttttaatggcaataggacatggtgtcagattaccagttatcggaacaattctcttttcctgaccaaatcttgttttaccctatacatc

SEQ ID NO: 360538 - DNA, 1207 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaaggaataaaattgaagggtgtttttcttagagaacatcatttgtcatatttatttgatcaagaagttgaagatttatataataaggtatgggacttacacatttattttgataaaagaacacagaaaaggtcaggtatgagcagaaaattgacatttatttcagcctaatgtggatactgtactctgaattaaaaatttcttttccttactcttccagcttttaaagataagtattatttcaaaatagtatttttttaattaatagattcaattcaggaaaggcattggagggggtggagcttttaactttgacagtctcactctgttgcccaggctggagtgcagcggcgcaatctctgctcactgcaatctctgcctcctgggttcaaatagttattgtggcc

SEQ ID NO: 360539 - DNA, 448 bp, Homo sapiens
gccacagctgatgtttttcactatttgtttcaataaaggtatatttctcgttgtagtttggcttttcataaagtaatttgattcataaaatgtgaaccttaactatcttcagatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccaggtatcgtgctgctgttacaaagaacttgatttgtttattttctgaacatgtcggtgatgttttcgtgaccagaaatacaccataggacacaggagaatcacttggacccgggaggcggaagttgtggtgagctgagattgcaccattgcactccagcctgggcaacaagagcaaaactccatctcaaaaaaaa

SEQ ID NO: 360540 - DNA, 311 bp, Homo sapiens
tgattaaattttttccactgctgttcacatcatgatttgttgtgattaatgtatgtggatgaggacataatagaaaaagaaaatgatgagacttgtatatattgtgtttctgcacaatgagttcctttgaatgtttttcgttttaggaataaaattgaagggtgtttttcttagagaacatcatttgtcatatttatttgatcaagaagttgaagatttatataataaggtatgggacttacacatttattttgataaaagaacacagaaaaggtagtacgatgaaggacggtaggtatgatgaagactca

SEQ ID NO: 360541 - DNA, 2252 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaaggaataaaattgaagggtgtttttcttagagaacatcatttgtcatatttatttgatcaagaagttgaagatttatataataaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360542 - DNA, 2762 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacaatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360543 - DNA, 2178 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaataaaattgaagggtgtttttcttagagaacatcatttgtcatatttatttgatcaagaagttgaagatttatataataaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360544 - DNA, 2140 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagagacacctggagataaaccctgaccattccattattgagaccttaaggctaaaggcagaggctgataagaacgacaagtctgtgaaggatctggtcatcttgctttatgttgt

SEQ ID NO: 360545 - DNA, 2169 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360546 - DNA, 1577 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagcttaacgaccgaaagcaacggactagccctcgggacaggacagatgcccaaacccaagggaacacctttgggagagcaaagttctgtaaccacatcgggatgcctgtggggcctctgcctcctgatcacgccactacggacacttaggatgcctgaggc

SEQ ID NO: 360547 - DNA, 331 bp, Homo sapiens
ccaacttcagcaggctgtgcagtcacaaggatttatcaattattgccaaaaaaaaattgatgcttctcagactgaatttgagaaaaatgtgtggtcctttttgaaggtaaagttgctgtttaaagctatattatttcattatctgcaaatttaactgttcctttatattctaaatctgtcctcctattaaagaaacaattgaaaaagtgtgatttcagcaattcatcatgaaattaagaagccttataaagagcatacaacctaacttatgtccagagtttttccttctctgctttgaaaagtgtaatatgaaatacatttttaataagta

SEQ ID NO: 360548 - DNA, 421 bp, Homo sapiens
cttggcctcccaaagtgctgggattacaggcatgagccacccggcctcaagtttgtcttctttctaatgaatatatccaacaaatgacacctaaaccgatttgatttatttgcagttgggcattactaatgttgtagtggtttgttcagtatgtttctatttaaaatatctgtgttctgtgttagacattcaagtcattcaaggctgtttctgtataaaatattccctttagcaggatgaagttaaaggaagtagatcgtacagccatgcaggcatggagccctgcccagaatcaccccatttacctagcaacaggtaagttcaaaggagagaagatagtatgagttacctaatttcttctcttctgcacctagcttattcagtttaagctttatcttctctagaaagcctctctctccct

SEQ ID NO: 360549 - DNA, 4125 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360550 - DNA, 3493 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagcgtaagtagtgtgaccccaaagtcctttcagagcagtatttatgatctaatttagtaactttactttgaagccccaaagtcattgtcaaatcaataagtaagaaccattgtgcataggattcctgagtccctgctacaaagagacatgtttttttaggaggtggcctgaatcactatgctaggaagtagctcctttgtcacactgttcagagtagttgactcctgttcctcagccattactaagacttgttaaagataatcaagtgtcccgtgattttggtataaagaaacagaattttagaaattattttttacatattctttttcttcaggcaagatgacacaaattatttttggaaaaatggtttcaaggggcatttgttattactgtttttccattttatttatttatttaatagactttgtattttagagcagtcttaggttcagaacaaaattgagcagaaagtacagagtgcccccactattgacatcctacgccacagtggtgtatttgttacaatcgatgaacctacatcaatgtctcattatcacccaaagtccacagtttacactctcagtgttgtacattctgtggattttaacaaatgtgtaatgacatgtatctattagtggcatttttaaaagaaaataattatacctggaaagtgaaatattgccactatttgaaaatttaaatgc

SEQ ID NO: 360551 - DNA, 4375 bp, Homo sapiens
agctttgaggtagagcccaggccaaaactgggaccgcagcctgggtctccgctgccccgcaccagcctgaggcccggtctctggtgacggcgcgcccctagtcttggtttcgggcccggcggaacaacgcctggcatctggactccagtgatcgcgcccgtccgcattcgccgacgtctccactgctgagcaaaagccacccgaggctggcgacagtgtcttgccggggagtagtagccgggctggtaactggagtttgagattaggagactttcagacccttgtgcacaaagagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360552 - DNA, 2095 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360553 - DNA, 4202 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360554 - DNA, 2214 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaattgtactctcagagatgttgagaaaagatacatgggtcttggaagataattactcaaaatatgcagggaaggaataaaattgaagggtgtttttcttagagaacatcatttgtcatatttatttgatcaagaagttgaagatttatataataaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360555 - DNA, 1980 bp, Homo sapiens
ggcccggccccgccccacgccacgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaagggtatggaagagggataaaacacggtgccttaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaaaaaaaaagga

SEQ ID NO: 360556 - DNA, 4001 bp, Homo sapiens
cccggaagtgttgggcgcagggcgtggctgcggctgcggctgccacgttggaacggaacgtggaggtggccctggccggggaggaggggcggcggcgaatgctgggagagtccgacgagcgctgcactaacgcaggatccggctgccgaaggtcctcgccagcaggatgaagttaaaggaagtagatcgtacagccatgcaggcatggagccctgcccagaatcaccccatttacctagcaacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgcttctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgtttttttaaaacctcaatatactttttagaaaaggagcatctggttatgcataaagcagagctaaaactaaatttctttcatgtcctccctacttcctcagtgtcaatcagattaaagtgtgtaatcct

SEQ ID NO: 360557 - DNA, 1017 bp, Homo sapiens
  misc_feature (925)..(925): n is a, c, g, or t
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaagttntgctcacaatggaaggcggttggcctctttaactactggccttacctctaagtctggttttaccttatagatccggaaactcttccaacaca

SEQ ID NO: 360558 - DNA, 1826 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360559 - DNA, 2634 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaa

SEQ ID NO: 360560 - DNA, 1354 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360561 - DNA, 1094 bp, Homo sapiens
cgcgggcacaaactaggctaggtacgaggccggtgttaatcggccgagggcgagctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360562 - DNA, 3062 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaaaaacaaacaaacaaaaaataaaacaaaaaaaaaaaaacacacacaaaaaaaaaggaaaaaaaaaggaaaaagaaaaagaagaaaaaagaaaaaaaaaaaaaaaaaaaaaaaaaagagaggggggggcgcgcgcaaaaaagatatctcccccgaagaggggcgcacaaagcaaggcgagacccccgatttttgtaaaaaaggggggccccaaaaaggggcgtcattatacaaagagggacacggggcatttaacaaacattagaaaagaggaaaacatctgccaacggggaacaactcagaagaaacacccccaagagagggggaggaacaataggtggaccacctccaccaaaaaagataataaccccccaagagaaacaaataaaaacacaccaagagggagagtagacagctgcgacaacacacagcgccaaacaacactccccggcggagtaaacaatctcgcccaccaagggcacaatctatcaaagaaattctccggagggagtattagataataaagaagacagaacagcagaagcacgaacagagagcccgcactcgaacaaacaacaacaataggcagagcagaagaaacaaaacgagcgcaaaaaagaagaggaaaaagccagaggacagcagatgacgtacacagggcacccagcagaacaccacacctagacgaccaataaataaacaagcgcggaccggggcggcgccccccacaccgaccccagcaggagcagcgtacaacagaacacagaaagccacaacgagcgtcaacataactacgatcatagcaccaagcaggaaccaaagcacaaagacatcaaacaagaacaagaacaaacacagaagaacacgacacgacaacggacgagacgcacaagagcgaaacaa

SEQ ID NO: 360563 - DNA, 1038 bp, Homo sapiens
tgcgactgcttccgaggtcatgttcccaggacgggcgcgtcttcagggtggaagcctggcgcacgtccggagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360564 - DNA, 1035 bp, Homo sapiens
ggttccggcgcttagggcgccgctaaactcagagcccgggagtcatggctgcgggcggtgccgccccagagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360565 - DNA, 2065 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaaaaaaaaaaaaaaaaaaaaaaaaaaaaaaaaaaaaaaaaaaaaaaaaaaaaaaaaaaaaaaaaaaaaaaaaaaaagagaggggggggcgcgcgcaaaaaagatatctcccccgaagaggggcgcacaaagcaaggcgagacccccgatttttgtaaaaaaggggggccccaaaaaggggcgtcattatacaaagagggacacggggcatttaacaaacattagaaaagaggaaaacatctgccaacggggaacaactcagaagaaacacccccaagagagggggaggaacaataggtggaccacctccaccaaaaaagataataaccccccaagagaaacaaataaaaacacaccaagagggagagtagacagctgcgacaacacacagcgccaaacaacactccccggcggagtaaacaatctcgcccaccaagggcacaatctatcaaagaaattctccggagggagtattagataataaagaagacagaacagcagaagcacgaacagagagcccgcactcgaacaaacaacaacaataggcagagcagaagaaacaaaacgagcgcaaaaaagaagaggaaaaagccagaggacagcagatgacgtacacagggcacccagcagaacaccacacctagacgaccaataaataaacaagcgcggaccggggcggcgccccccacaccgaccccagcaggagcagcgtacaacagaacacagaaagccacaacgagcgtcaacataactacgatcatagcaccaagcaggaaccaaagcacaaagacatcaaacaagaacaagaacaaacacagaagaacacgacacgacaacggacgagacgcacaagagcgaaacaa

SEQ ID NO: 360566 - DNA, 2213 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaaggatatggcgaatgtgtcagtaacgtcagtaataaactattctttctttgaatcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaa

SEQ ID NO: 360567 - DNA, 2598 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaa

SEQ ID NO: 360568 - DNA, 2091 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaa

SEQ ID NO: 360569 - DNA, 901 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaacctgaccgtggagccactcttccataacacccagaagggagcgctatctgaatgtccgttttcacaacagctttctccaatccccggtcga

SEQ ID NO: 360570 - DNA, 756 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagggcttttgtttggggtagagtattaataacaagtaagatgtgacatggagctgtcttcagttagattcacgtgagtcttatccagcctttca

SEQ ID NO: 360571 - DNA, 2225 bp, Homo sapiens
  misc_feature (2166)..(2166): n is a, c, g, or t
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaaaggngaagtcaaaaaacaaattggcgggcccagcctattcccttagcgagggtaattttacct

SEQ ID NO: 360572 - DNA, 1285 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccaagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360573 - DNA, 2157 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacaggtgagcggggacctgccggcgaggaggctgggaagggccggccgtccgctgccacagctagaaacagtcaccggagagatcacaggaacacactagctataaataggatttctgcctttttcgtgtttaaaattttagctttcatctttggcataaattaaatagagatttgggcaaagactgcagaataagtaaaatagctatacggtgtctagcaaggcgttactttgcaacgtttattgtgcccttcctaaatagaagatagagaggaaggcccatggtggctttcgagtggcccgagggtgatgctgtgctcaatagaaaaaccaagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaagtcaaaaaaggtgatcgaattgcacagctcatttgcgaacggattttttatccagaaatagaagaagttcaagccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggt

SEQ ID NO: 360574 - DNA, 2649 bp, Homo sapiens
tgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccggagacacccgccatttcacccagtaagcgggcccggcctgcggaggtgggcggcatgcagctccgctttgcccggctctccgagcacgccacggcccccacccggggctccgcgcgcgccgcgggctacgacctgtacagtgcctatgattacacaataccacctatggagaaagctgttgtgaaaacggacattcagatagcgctcccttctgggtgttatggaagagtggctccacggtcaggcttggctgcaaaacactttattgatgtaggagctggtgtcatagatgaagattatagaggaaatgttggtgttgtactgtttaattttggcaaagaaaagtttgaaggatatggcgaatgtgtcagtaacgtcagtaataaactattctttctttgaatcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaaaaaa

SEQ ID NO: 360575 - DNA, 676 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgtcgacgttggctcccgttgtgctttttgtccggctgccgtctt

SEQ ID NO: 360576 - DNA, 718 bp, Homo sapiens
tgtacgccaactgatatgctctgaattttagataggtctaaatcacaatggtacagtctgatgtgaaaattagtctacctaccataaactcgttttctgaatcagtccttattcataattagacccaaaacccagctatttctcctctcttagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360577 - DNA, 2265 bp, Homo sapiens
  misc_feature (53)..(53): n is a, c, g, or t
cgaggcgaaagagttagtctaggtcgagctctgggtgtcaatttcgtgccganggactgtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360578 - DNA, 2573 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagtctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360579 - DNA, 1702 bp, Homo sapiens
gcggccgcagcaaccgcgccgttgacttctcggactccagaagtccccggtagccgggaggcggccgtcacttcctgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360580 - DNA, 1616 bp, Homo sapiens
gttcactggtatatttggtcactcttagaaccttccttcacatgttttttatgggacccatgaatggttagcctttcttttctatgtagaaggaaataaataggagtaaaaagaccattgtagtaaataagttcaaggggaacttgggaccagaaaccactgttatgtacaaaaaaatggcaaattcaataaactcaaatttaaaataatttttaaattaagttatgataaattttatattttatacaaatagattgcttagaatggttctcaagaattataagagaaatgaactcaaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360581 - DNA, 2574 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360582 - DNA, 1083 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtaagtaccttgtatttttaacattgcttatttttgtttccttagaaatatggaatttggagagtactttgacagttatacagcatgttagagttgtttttcttataacttactttttagtgtaattttgaatagaagacctacaagctcaatatgatagcctttaaaacctagagcctatagaatttgactgaattttgtt

SEQ ID NO: 360583 - DNA, 2627 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360584 - DNA, 2585 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaagattgttttgtaacacataaaaaaatggaagaaactgataccacacctaaggaccaaagataagaaagactttttgcccaagacagtgaaagtaattataaaaacaagctttgaccacttaccaagtatctgaagagatgagttcatactatgatttagaaagtggttcaattcccctgttggcatatgattatttttactaaaattaatacagctctgtgggtcttccttagtgttttctttgaagccaatctgttttttttaggacaccagcctttggtttttcatctgttcgagatgcctcttctctgtctccttatcagatagaaatggagtcatgtgctgctgcttcatctagcagaggttggcctctggctctgacactttttgtcagttgtctttaggtggtcctgaatcttgggcccttttgattgtgaatactgtgtagcaggatcttgagagtccttgttcttacataggcattgctctagtttgtctttggcaaaaaaaaaaaaaaaaaaaaggtaaatatccagggaaccctgcccagactaatactgtggggggcataagagaatcaagccattctcaagagataacttcataaccagaattgtctgttggctagcagctgtcacagataggcgggcacttgggatatgacctttctgtccgggtgattcacagattagaccttttttatcctcctcctagagttttgacttgggactctagtgttaagatgatgagcccgtgcatcaggtccttctgcactttggtggaagtctcccagggtaggtttcctatttgaaacagtggaatcatgtttccagtgataaagtttaatgacctcatccttttttttttttctcatctgccatttgtgtg

SEQ ID NO: 360585 - DNA, 2557 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagaaaacaattgtttttaaatcacacagctcaacggttgataaatgattctgtcattctgttacaggtcattcttttactaggcttagcttccaaattatgctttatagctgtataaacatcgtgattatattcatctacttagaaattgttttatttttaaattaatttgcttagctgtttgttttgatgcttagattatgttctgttaatgggaatttaacatatttaagaaaccaatatttaaaatgttggtctaggtttttttccttaacatatattaccaggctttactgtatttcactcagccttaaatgttataatatttttggataacggttattaattctttgagaccttcgtatagcctataaaatgtatgggagatgttggtattttatgtgtataaaagcaacaatatcagcaacttcgtgtttatactgcaccttggttgttgatgtcaagtaaaaaaaaaaaaaaaaaaaaaaaaaaaaaacaaaaaaaaaaaaaaaaaaaaagcaacaaaaggtgaatatatctacccggggagcgcccccgccccccaaaaaaataaagagcgggggggcgggcacaaacaaaaaaaaccccacccctcctctctccacaggacaatgtatctcctgtccccaccacaagccaaaaattgtgtgtgtggggggaggcaaaacacgcgggggcacaacaaaactagatagagggaggcgacgcctgtggggggaaaatagcaagacccacctttcggtgtcgcacagcgagggagtggagtatacacacaagcaggaaagaagaacccgcttgtatataagatatccaccccccgccgcaggaaagaagaatgtgaggattaggccaagcagggggagcagcccacactcggaggtggtagccaacaataggagaaagacgccccgcgggggtaaaattagagggagtcctatcagtatcgcgcaccaacagtggggggaggggaaaatctctccccctaccaggagggaaaggagagcgagtgtgtcacaaactttgaggaacaaacacaccagcggggggggacaaactaggatggttgggtcacagcagcgggagaggaatagacagatgttatgtaaaggacgggggcacaaccgactaaccgactctattatttgaagtatgagtgtcagtagcagataactgagcctggacaggccagaagtagggggggtgggtctaaccaaacatagagaggcggcggcaggacaaaacgcgagcgcaggcacggagcaacagaagcg

SEQ ID NO: 360586 - DNA, 950 bp, Homo sapiens
ttttcgtatcatattttcacgtcacttatcactatctgaaattgctatccatctgttttcttgtttattgtctgtctctgttactagggatcctgtgattttgggtagtacttggctgtcacccaagtacctagaacggggttcactgcacaccgaaagtacgcaaaaatactaagtgaatgaatgtcaggaggatgaaagatggagggaggtgagaaatccatcaaaggctcacagaaagaactcaattcttggatgaaagtcggaagaatcccaacagctaacaagcaaatttgctgagagggggcggggcgggccaagggcgggggcgggaaggggcggagtcaggcggaagccggggagaaggcccaggaagtgacggccgcctcccggctaccggggacttctggagtccgagaagtcaacggcgcggttgctgcggccgccgcgctccccggcccgaggcgatggagaacggagcggtgtacagccccactacggaggaggacccgggccccgccagaggcccccggagcggcctcgctgcctactttttcatgggccggctcccattgctccggcgcgttctcaagggcttgcagctgttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcgaatttttaaattaacagttatgataaattttatattttatacaaatagattgcttagaatggttctcaagaattataagagaaatgaactcacagtacaaaaattttataattactatacttgtgttttgtttgggggctgggaaatgtatttttacattgtagccaa

SEQ ID NO: 360587 - DNA, 226 bp, Homo sapiens
acagtgacaataataaatataatcaactctcgagccagccatccccactaaacctagtgggtcacatctggtgtttcactttggggatgttttagtggtcatggtagattgttgtctgactgctggctgtttctaccatgtttcaggaatatagagatgtgtacagatgacccctaaaattaattagtatgcaattctcaaagagacaaactgtatcccagaagct

SEQ ID NO: 360588 - DNA, 483 bp, Homo sapiens
actgggagagagatacatgtttcaccacaagggcagccaggcaagggggcacctttactctcacacatctaggaggtgttttagtctaggctctattgctaaggggccaataaaaatatttttttctcactggaccatttttgtttatatacatatatatttacacaaatatatgtaaaaattcaaaatgcaaaaatatatgtagtggccgggtgctgtggctcatgcctgtaatcccagcactttgggaagccaaggcgggtggatcactctcaggagttctagaccagcctgaccaatatggtgaaaccttgtctctactaaagatacaaaaattagccaggcgtgctggtgcttgcctgtagtcccagctactcaggagattgagtcaggagaattgcttgaacctaggacgtggaggttgcagtgagccgagattccgccactgcactccagcctggttgacagagtgagactctctca

SEQ ID NO: 360589 - DNA, 2127 bp, Homo sapiens
atttttcatgtcacataattttggagtatgtcatggacatttgaatattttgttacaaaactggatgctgttaaaatcctctggaaaatatttttggttttttggtttcactttagcgggcagttaacctggttaggttcagactgcctctgtgggctgtggatccagtttgaacttacttttcaaaaccttcgtattgctgttcaggtcccaggtgtgccatccatgccattgtgcagttctcaacgcctttcctctgccgccttgggtcagttcacacatgggcatgttggtggtaaacttgagattgtatacacaaatttagaggacgtttcttctctccgtgacttcccttgtacacaagctcccaagagtttcttttcgtggttctttggtgagaaaactggaattttagcttctttgtgcttttcatacgttttctgtagaggggctcatttcctgaacaaaatggagagagagaaaagttagagaaaaaaataaaatgaattccctcttccatactcttccgatcatcgtctttttcctagttcttttgtcagaagaactctcttttagagtttaggagacagctaccagccacaggtgtgcagactcaggattggggcttgctttgaggcagagctgagagagaagaaaaattaccagatatccacccctccccattgtccctctcccattcatcatcttttctagttctctagccagaaggagtttctcttggaacttttctctgtcttcactcactgcacagttaatgagatttgggctgtcctcaagtctaagctgacatatgtgggagaaaaaaaccaggaaactcactactgttttgagttttgatttctctcgccagtctgcttgcttcaaattacttttcagagtccttgtatatttgctttatgtattctttccaggatttttagtaataatcaatggacaagatagggtggagtgtgctttctccatcttagctagaactgggaccccgtcccccactcgtaaaatataaataatgacttagcatggcacattaggtgggcattagagacaccagggaagcgattacaaatataaatgcccaggttgtatctccagataattaaaaatctttcaggagtaggatccagaaaactatatttaaaagttctctaggttcttgatatactatgtaggttgtggtctgaggaccactacatggggatcatttggaaacttgttagaaatgtagactcaggttccattccagacctgctgaattggaacaagatccccagatggtgcctacgcacagtaaaatttgagcagcactgccctagcatgattctagtgtgcagtcaatgttgaggaccactgtcttagaggattgcgtaaaagcaaatgacgtgtatataaatttagattgtaatattctctgagtataaactcattaggtgcaagctgagctcaccctccatgttttctgtgttcctggttaaagtaagttacctttgatgaaaaccacaggttcatctttgacttcaaatcagatttgttgctattgaagctaattggatcccagctcagctttgtggcttggattcacaccatataaaatcttcaacagacattcattcctttgttcagaacacacaaccttctaacgtgaacctccaattttctaaattcattctttttctacttcacctgaaaccacagatccatggcacttagtttctctgtaacagcagctctaccatggtgtccagaaattttagcccctactatcaagaacaaaacatccttgtacatgtttatacatctttttgagtaggagttttccaccagttgcagggattccctgagtctagagtaatgccacaatgctgctcccttttactcctttctaagcatttctgtcagggagaagacttagattcagttgttcactttaacattttccttagatactctcttagaaaagttgtattctgcgcacttctgttatgaagggagtaagggattgctgagatttgttaagttaccaaactagtcttgatagatgtataattattacatatccaccatcacttcatttagctgggcaacaagggcaaaactctgtctcaaggg

SEQ ID NO: 360590 - DNA, 2691 bp, Homo sapiens
  misc_feature (2353)..(2353): n is a, c, g, or t
atttttcatgtcacataattttggagtatgtcatggacatttgaatattttgttacaaaactggatgctgttaaaatcctctggaaaatatttttggttttttggtttcactttagcgggcagttaacctggttaggttcagactgcctctgtgggctgtggatccagtttgaacttacttttcaaaaccttcgtattgctgttcaggtcccaggtgtgccatccatgccattgtgcagttctcaacgcctttcctctgccgccttgggtcagttcacacatgggcatgttggtggtaaacttgagattgtatacacaaatttagaggacgtttcttctctccgtgacttcccttgtacacaagctcccaagagtttcttttcgtggttctttggtgagaaaactggaattttagcttctttgtgcttttcatacgttttctgtagaggggctcatttcctgaacaaaatggagagagagaaaagttagagaaaaaaataaaatgaattccctcttccatactcttccgatcatcgtctttttcctagttcttttgtcagaagaactctcttttagagtttaggagacagctaccagccacaggtgtgcagactcaggattggggcttgctttgaggcagagctgagagagaagaaaaattaccagatatccacccctccccattgtccctctcccattcatcatcttttctagttctctagccagaaggagtttctcttggaacttttctctgtcttcactcactgcacagttaatgagatttgggctgtcctcaagtctaagctgacatatgtgggagaaaaaaaccaggaaactcactactgttttgagttttgatttctctcgccagtctgcttgcttcaaattacttttcagagtccttgtatatttgctttatgtattctttccaggatttttagtaataatcaatggacaagatagggtggagtgtgctttctccatcttagctagaactgggaccccgtcccccactcgtaaaatataaataatgacttagcatggcacattaggtgggcattagagacaccagggaagcgattacaaatataaatgcccaggttgtatctccagataattaaaaatctttcaggagtaggatccagaaaactatatttaaaagttctctaggttcttgatatactatgtaggttgtggtctgaggaccactacatggggatcatttggaaacttgttagaaatgtagactcaggttccattccagacctgctgaattggaacaagatccccagatggtgcctacgcacagtaaaatttgagcagcactgccctagcatgattctagtgtgcagtcaatgttgaggaccactgtcttagaggattgcgtaaaagcaaatgacgtgtatataaatttagattgtaatattctctgagtataaactcattaggtgcaagctgagctcaccctccatgttttctgtgttcctggttaaagtaagttacctttgatgaaaaccacaggttcatctttgacttcaaatcagatttgttgctattgaagctaattggatcccagctcagctttgtggcttggattcacaccatataaaatcttcaacagacattcattcctttgttcagaacacacaaccttctaacgtgaacctccaattttctaaattcattctttttctacttcacctgaaaccacagatccatggcacttagtttctctgtaacagcagctctaccatggtgtccagaaattttagcccctactatcaagaacaaaacatccttgtacatgtttatacatctttttgagtaggagttttccaccagttgcagggattccctgagtctagagtaatgccacaatgctgctcccttttactcctttctaagcatttctgtcagggagaagacttagattcagttgttcactttaacattttccttagatactctcttagaaaagttgtattctgcgcacttctgttatgaagggagtaagggattgctgagatttgttaagttaccaaactagtcttgatagatgtataattattacatatccaccatcacttcatttagctgggcaagtattatcagtttggttcatgttagctaattaggtcactggtttgttcctaggacagtgttgggctggtcatataagttagaagcacctgggagctgggcatggtggctcacgcctgtaatcccagcactttgggaggccgagcgggcggatcatgaggtcaggagatcgagatcatcctggctgacagagtgaaaccccgtctctactaaaaatacaaaaaaaattagctgggcatggtggtgggcaccngtagtcccagctacttgggaggctgaggcaggagaatggtgtgaacctgggaggcggagcttgcagtgagctgagatggcgccactgcactccagcctgggcgacagagcgagactccatctcaaaaaaaaaaaaaaaaaaaacacacctggggtgctcataataaaaaaaacaaaaacccagatatttatcccagttttgattccaaagatcaggtaccagtactttctttttggagacagggtcttgctctgtcacccaggctggagtgcagtgtaccatcatggctcattgcaaccttgacctcctgagttcaagcagtcctctcacctcagcct

SEQ ID NO: 360591 - DNA, 3516 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaataaaaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360592 - DNA, 3840 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaaggcacgccccggcccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgttctgaggttgtgactgctgttgccccaaaggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaataaaaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360593 - DNA, 2247 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtacacagggaagtgtgtcttctcccatgtcaagaagaagtggcctttccaggaatggagctattgagctgaaatggctgccactgcgcgtacacacacacacgcgcacacacacacacacacacacacctcccttccagttccagctgacggtgactttttgactggtaaccataaaagaattcattcaaaagggcagttgttcccagcagcc

SEQ ID NO: 360594 - DNA, 1399 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagagggtgctgaaaaagttcacccaaccacttcagctgacctttaaggtcaggaacaaaagccaacttttaccattccccagggaggaccccaagggggcctggcacaaggaaatttcccaaaaagggaattggccaaccccaattcgggggggcacaactaccaagttccccggtggaacaaaaccccctg

SEQ ID NO: 360595 - DNA, 939 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360596 - DNA, 3674 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaaggcacgccccggcccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaataaaaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360597 - DNA, 3750 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacggcatcgaaagcagaaagtgtctgtgatggacaagctggtcagaagacatccgagatccaggctagaggcaccaagaaaaagcacctggatagccccaggctaggactcgcctttagaaaattctttaggcataagggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaaggtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaataaaaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360598 - DNA, 3506 bp, Homo sapiens
attcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccaaggcacgccccggcccaagacaaggtcctctctgccgccaggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaattcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaataaaaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtatcttttaattttcaacttcaaagcagtcccactctatatctgagatgactctaacttctacattataaaatccatactctttctccattatcttctttggaagatcattctctcccagatcttcccggatttccttgtatatgggcacacacacacacaaatgtgtgcagttgtatgtttgcatgtacacacacatgcatgtatagaatagtgctgtcttaggccaggttgcttggagcagagcctgagatggggatttggacgcataggatatactgagagtgggctccgagggaaagggagtaagagaaaaagaagagggcaagaaaagagttgggcaagggttggtttcaactggagcatgaattgcaccac

SEQ ID NO: 360599 - DNA, 204 bp, Homo sapiens
cggggcccatgctatcctcaacgcggggttttctgtggttttttatgaggaactataagttaccaaaagttgaatgttgtcatttatttgtgctcagtaatgattttcatttctttgttatcagagcttatcacacagtgtctgaagtccacatggtgagagtggcctgcattccattccagtttctgtcctccaaaataggtt

SEQ ID NO: 360600 - DNA, 1025 bp, Homo sapiens
gtaaagcttcctctagatgatccccccacggtgtccataaatatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactga

SEQ ID NO: 360601 - DNA, 389 bp, Homo sapiens
actggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaa

SEQ ID NO: 360602 - DNA, 528 bp, Homo sapiens
agaggctttctatttttccttcccccctcgctttcccaccctaacttagcttggaagtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatactcgctttccactaggggtccagatcgcgaattcg

SEQ ID NO: 360603 - DNA, 854 bp, Homo sapiens
  misc_feature (720)..(720): n is a, c, g, or t
tgctggtactggcccgaatcgttaggaggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccgggcttttccaatcaagaatacatcctgaagactggtgcncacggtgttatgaaggacaagagtgtgcaagtcatgcggtaattcctaccagagcacggtgaccaatcaaggtatacgtcgcttacttatgagggatactgtaggtcaacctgcaggatgacagctgcagtcat

SEQ ID NO: 360604 - DNA, 450 bp, Homo sapiens
aaaggcagggggtggggctgcttcatattgaggctcgagtcataaggggctctggagggtctgtgggcacagccccacacccttgtcctggggcctctttcctcttccctctaggctggtctcccttcgtcagtgcccaccacccttaacagtttgcatttctgttgtttcttccagtctccatctgctgctgcctcttcatcctcttcctcttcctctcggagctcaccggatttataacgacagaagtgtaagtcatactttcccgatggggcattccaggatgttctgggaccccagacaagaagagggaggggtctttggccaggtttggtggctaacacctgtaatcccaacactttgggaggccgaggcgggcggatcacctgaggtcaggagttggagaccagcctggccaacatgctgataccctgtctacactaaaaatac

SEQ ID NO: 360605 - DNA, 2882 bp, Homo sapiens
  misc_feature (9)..(9): n is a, c, g, or t
ggctggtanggtcccgagtcgttagatcggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360606 - DNA, 3200 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaaaaaaaaaacataacagacgaacacaaagaaggaaaagccaaaaacgcaaacgcagaaaacgagacaaacaggacagcggaaagagcgacaaaaagcagaagagagccgcgggggagacaaaggcacgcgaggacggagccaggagggagagttgcgacgagcaaccggcgagcaagagagcgagcagtgcagacaacgagagagtcacgaacaccgcagcgcacagcgcagaagcgaccgggagagagcacgggagagg

SEQ ID NO: 360607 - DNA, 2588 bp, Homo sapiens
agaggctttctatttttccttcccccctcgctttcccaccctaacttagcttggaagtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360608 - DNA, 2895 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360609 - DNA, 2842 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactccctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360610 - DNA, 2767 bp, Homo sapiens
tgctggtactggcccgaatcgttaggaggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360611 - DNA, 2442 bp, Homo sapiens
atttgggttgtttccagaattttaatgatgtgcacagtgcaggaggaaagatcctgatggatagagtctcccaattcccggtatccaaggggagaagatgaagagcagttggttggtggtaaaactggggaatgagccccctgccgtgcccagggaatttaggcttaggattgaaatgacatagagctgtcagcgggcagtgcccgtccccctgcttcattctgctgtgtccttcccgcagccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360612 - DNA, 2459 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360613 - DNA, 2476 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccaggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360614 - DNA, 2176 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagtttctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360615 - DNA, 1853 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatatggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360616 - DNA, 1621 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggagcaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360617 - DNA, 1088 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactctgggcactgtttggactctgagcactgtttggactctgggcactgtttggactccgggcactgtttggactctg

SEQ ID NO: 360618 - DNA, 1100 bp, Homo sapiens
agcgctttgtgactggtgggcagattcaagtctctaccgctgctgctgagcaactgggcatctgcttcttggaagaacaagaaaggggtggggtaaagacttgaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360619 - DNA, 880 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaagaatacgtcgctttccacctagacgtcgctttccacctag

SEQ ID NO: 360620 - DNA, 914 bp, Homo sapiens
  misc_feature (780)..(780): n is a, c, g, or t
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccgggcttttccaatcaagaatacatcctgaagactggtgcncacggtgttatgaaggacaagagtgtgcaagtcatgcggtaattcctaccagagcacggtgaccaatcaaggtatacgtcgcttacttatgagggatactgtaggtcaacctgcaggatgacagctgcagtcat

SEQ ID NO: 360621 - DNA, 3388 bp, Homo sapiens
  misc_feature (3053)..(3053): n is a, c, g, or t
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggttaggatgctggggcccagagaggttaagtgtcttgcccgaggtcacacagctatctgcatgtcccacaactccccttcccagccccagccaaactgagccactggccactcctggcttctccttgtccctcctgcagcctctgctcagaacgcccttcctccagaccctgacacctgagctggggttgcaaagtcactggccacatccagcccaaagataaattttgtttgtccagtatagcatttaactgcatcagaaccagtatgaaaagaccaggaatccagatttctggcttttaaaagtcagaggctctcactacactgggtccgtgttcccgctatgacaatgacctggcaccaatgggcagtgttcccctttagagagggtgtgtgctgtcccttcccacagtccctggcaggcggctggaaggccaggcctggtcatctgtcaagcagggtggacttcttacgtgacagttcagggctcccttaagtgctaaagcagaagctgcaaggctttcttaaggtttcgagtgttgctgggagaaatctgctgcatgttgtgggttaaagggagtctctcaccagcccaggccctcaggaggaggagataccaggaggcagggatgctgggggtcgtggttcactgggggctctctctgcccatgagctgccacacagcacctttgccatgccccgtaatttggattttatggtggttgtgatggaaagccatttgagggttttgaacagggaggcaatgtaatcagatttatgccttagaactggactatccaataggttgccaccagccacataaggctatttaaattaattcaaattaaatgtacaattcagtcactcattctcatcaaccacatttcaagtgctcaaagccacgtgctggctaggggccacagcgttagacagtgcagagagaaagcacttccatcgctgaggaaagttctgctggaccgcacacccttagaaggatggctctggtggccgggcgcggtggctcaaacctgtaatcccagcactttgggaggccgaggtgggtggatcacgaggtcaggagatcgagaccatcccggctaacatggtgaaaccctgcctctactaaaaatacaaaaaaaaacaaaattagccgggcgtggttgcgggcacctgtagtcccagctactcaggaggctgaggcgggagaatggcatgaacccgggaggtggagcttgcagtgagccaagatcgtaccactgcactccagtctgggcgacagagtgagactccatctcaaaacaaacaaaaaaaggatggggctgggctggagagggtggcaggcagtggttgtggcagtggagctggggagatgtggtcggattagggaggtagaatcaataagactcagtgaagaatcggatgtgggggtaagggcacatgtggaagcaaagaaacctttgacgtctttgtcttgacaaccgggtggtcctgtttctagacatggaagcttagaaaagcctggagtctgtgggaagtaggtagggctgggcactggtcattccactctggtttcctttggggttcccattaggtgtctacagggagaggtgaaattggaagttggaggtgtggagagttcaggagagggttctggaccacagatgttgaggtgggagtcattagtgaatagatgatgttggaagtcatgggtcctcagagtgggggctccttaagcctccaggccagcagcatcagcatcacctgggagattgttaggaatgcagattctcaggcccccctaagacccaccgactctgtgctagaacaagcgcccctcagagattctgatgccactgaagtttgaggagcattggtttaagcaagattacctacggagaggctgtagatccgtgttctaaacctggggtccacagacacccccaagaagagcggattgaatgcaagagatctatgaagttggatgggggaaaaattgacatctttatttttgctaaactcgatctaaagtttagcatttccatctgcgatgaatgtaggccacaaaccacagtagtattagcagtgcctgggacctcctcaacaacagaaattgccggtatttatagcacgttacagttgttgcagataatttccagagactgtttatatgcaccactgttttaaaattacggtgattggccaggtgcagtggctcacacctgtaatcccagcactttgggaggccaaagtgggtggatcacttgaggagttcaagaccagcctggtcaacatgtcaaaaccctgtanctacaaaaaaatacaaaagttaaccaagcctatgcttgtagtcacagctactcgggaggccgaggtgggagggtcttctgagcccagggaggtagaggcttcagtgagctgagatcgcaccaccacactccagcctgggtgacagagtgaaacccttaatcaatcagtcaataaaaattacagtaattattagacccaccactaggtcatcttatttgatgcatcagtaaagcagcatattcaaatgtggatttttaaatattttaattactatttaaatatctctttactttgtaatcctatgcattttacgcattaaaacattttaagcattt

SEQ ID NO: 360622 - DNA, 246 bp, Homo sapiens
cactgcccccctcgcctcacgtttagcggagtcattgtcctgtcccctgtagtctttggaccccagaccatgagctcctggaggtccccagcccggcctgcccctgcaatggatgaatgaaggctcccagagagaacaggctggcccccatcctcccgcgtctctgggtttgtgactgttgtctccctttggctcctgcagtggttgggcttgacattcaggatgagatgggcaggcacgaagtgg

SEQ ID NO: 360623 - DNA, 752 bp, Homo sapiens
cacatgctgggaagtttctgtcctctgcacctgttcatgctgttccctctgcccagatgcctttcgctctcttcctgagtaatgcagactcatcttcagagccttaacacaggatgtccttccccctgggaagccctccctgaatacagcctgcaccctcaattgagccgggggccttccctgtaacccccatggtctgcaaattcctctgggccagggtggatcccacagagtctcattgtctgttccaagtctgtgtcacaggggcttggccaaggccagattcttgtctgctcatctccccagttccggcatctcctgaaggactggcgccatgtggccatcagcccaggctgcggaggtagatggcatccaggcatcagaggagggagcagtgcgtccaacagacgtgagctgagactgcagctctcgacatgtgaccttagcaagtttcttcactgctctgagcctccattttcttttctgtaaaatgggaattatcagatgacaaagtcaaaggattcagtgttgtttgtttagtcattcattcattcaaaaagtgtctattgagcacctgctatgtgtcggagtctggggagcacagcagggcgtggacatgctaatgggaggaggcagacgagaacaggatgggtatgagatggcaggtgatcccagaggctgtagcaggtaaggggatggggaatgggggccagggtgctcttttgcacaggtggacgtggagggcctctctg

SEQ ID NO: 360624 - DNA, 1703 bp, Homo sapiens
aaaggcagggggtggggctgcttcatattgaggctcgagtcataaggggctctggagggtctgtgggcacagccccacacccttgtcctggggcctctttcctcttccctctaggctggtctcccttcgtcagtgcccaccacccttaacagtttgcatttctgttgtttcttccagtctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatatggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360625 - DNA, 3948 bp, Homo sapiens
  misc_feature (3613)..(3613): n is a, c, g, or t
gaagcccaggctctccttagttgactgtgtgttaatcacccagcaatttcattactcaacagctctccagagttgcacattacagctggggtagaaattgggtgctgaaggccaggcagagcatttggctgtagggaggccgatcctcctcgggcctgttaccggcgggtctttgttcttagacctggggttcttggcctcacggattccaaggaatggaacgttgggccatgcgtgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtatggaagccctgcctcagccctttctacctgctcccctttcctgctgtctccccgctccctggaaactggttgtggaggcactcactcgacctgaccctgacacagcccccagcaagcgagggttcgtgtccagctgcctggccgttcctgctgagaatctggatgggggtccaggctccctggggttttaagcccctgatggctggttcaggaaggagctactcttctctccagtgagggggacaatgatgagaagacctgaggatttgcagcccccagccctgggttcaagtcccagctctaccccttcttggcccctacaagtcacttgacccatcttaggctgagggtgtgatggcgataatagtatcacgataccacccacttcacaaagtttgtgtggggattaaatgagctaatgcagattcattcattcagaaaaatttttgaatggcacgttctgtgttccagggtcggtgataggctctggggcagcgttcctgggctggtggggctcccattctggtagagggagacagtctacaaaccagaaagcatcagggatgctaagtgcagtgatgaggaataaagccaaggggagtgagatgaggtgggcttgaaagtaccttgtccgctcagaaggaccattcaaggttcactgttgttttgtcctcagaaccaggagcttcagatcctaagtcaagtgggtgaacgcagtgcccttgggagggccgaggcacccggtggcagctggcagggttttgctcagcacgtgccggccttcctcgaagctcggtactgtcacagtggagcctctcaacaacgctgtgaggcagcaccatttgacaggttaggatgctggggcccagagaggttaagtgtcttgcccgaggtcacacagctatctgcatgtcccacaactccccttcccagccccagccaaactgagccactggccactcctggcttctccttgtccctcctgcagcctctgctcagaacgcccttcctccagaccctgacacctgagctggggttgcaaagtcactggccacatccagcccaaagataaattttgtttgtccagtatagcatttaactgcatcagaaccagtatgaaaagaccaggaatccagatttctggcttttaaaagtcagaggctctcactacactgggtccgtgttcccgctatgacaatgacctggcaccaatgggcagtgttcccctttagagagggtgtgtgctgtcccttcccacagtccctggcaggcggctggaaggccaggcctggtcatctgtcaagcagggtggacttcttacgtgacagttcagggctcccttaagtgctaaagcagaagctgcaaggctttcttaaggtttcgagtgttgctgggagaaatctgctgcatgttgtgggttaaagggagtctctcaccagcccaggccctcaggaggaggagataccaggaggcagggatgctgggggtcgtggttcactgggggctctctctgcccatgagctgccacacagcacctttgccatgccccgtaatttggattttatggtggttgtgatggaaagccatttgagggttttgaacagggaggcaatgtaatcagatttatgccttagaactggactatccaataggttgccaccagccacataaggctatttaaattaattcaaattaaatgtacaattcagtcactcattctcatcaaccacatttcaagtgctcaaagccacgtgctggctaggggccacagcgttagacagtgcagagagaaagcacttccatcgctgaggaaagttctgctggaccgcacacccttagaaggatggctctggtggccgggcgcggtggctcaaacctgtaatcccagcactttgggaggccgaggtgggtggatcacgaggtcaggagatcgagaccatcccggctaacatggtgaaaccctgcctctactaaaaatacaaaaaaaaacaaaattagccgggcgtggttgcgggcacctgtagtcccagctactcaggaggctgaggcgggagaatggcatgaacccgggaggtggagcttgcagtgagccaagatcgtaccactgcactccagtctgggcgacagagtgagactccatctcaaaacaaacaaaaaaaggatggggctgggctggagagggtggcaggcagtggttgtggcagtggagctggggagatgtggtcggattagggaggtagaatcaataagactcagtgaagaatcggatgtgggggtaagggcacatgtggaagcaaagaaacctttgacgtctttgtcttgacaaccgggtggtcctgtttctagacatggaagcttagaaaagcctggagtctgtgggaagtaggtagggctgggcactggtcattccactctggtttcctttggggttcccattaggtgtctacagggagaggtgaaattggaagttggaggtgtggagagttcaggagagggttctggaccacagatgttgaggtgggagtcattagtgaatagatgatgttggaagtcatgggtcctcagagtgggggctccttaagcctccaggccagcagcatcagcatcacctgggagattgttaggaatgcagattctcaggcccccctaagacccaccgactctgtgctagaacaagcgcccctcagagattctgatgccactgaagtttgaggagcattggtttaagcaagattacctacggagaggctgtagatccgtgttctaaacctggggtccacagacacccccaagaagagcggattgaatgcaagagatctatgaagttggatgggggaaaaattgacatctttatttttgctaaactcgatctaaagtttagcatttccatctgcgatgaatgtaggccacaaaccacagtagtattagcagtgcctgggacctcctcaacaacagaaattgccggtatttatagcacgttacagttgttgcagataatttccagagactgtttatatgcaccactgttttaaaattacggtgattggccaggtgcagtggctcacacctgtaatcccagcactttgggaggccaaagtgggtggatcacttgaggagttcaagaccagcctggtcaacatgtcaaaaccctgtanctacaaaaaaatacaaaagttaaccaagcctatgcttgtagtcacagctactcgggaggccgaggtgggagggtcttctgagcccagggaggtagaggcttcagtgagctgagatcgcaccaccacactccagcctgggtgacagagtgaaacccttaatcaatcagtcaataaaaattacagtaattattagacccaccactaggtcatcttatttgatgcatcagtaaagcagcatattcaaatgtggatttttaaatattttaattactatttaaatatctctttactttgtaatcctatgcattttacgcattaaaacattttaagcattt

SEQ ID NO: 360626 - DNA, 2941 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360627 - DNA, 2757 bp, Homo sapiens
cggtccaggctggaccattgacgctgaactgccctcgaagtcggcagctgccccattgttcagcgggatcttcatggagttgtcgatgtggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360628 - DNA, 2888 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccgtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360629 - DNA, 3162 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggaagttgaccagcagccagatgtcagagtttgcgtgttttgagcagcagcggcagcctcaccagagaccccacggtgacctcgtttcatcagccagccccgcaggaggaggacaggatgggacatgcttacaaaatcagactttgatgggctgctgcacgataagctatattccctcctcggacacagctcgcacagtcttcttcattgggctggaataaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360630 - DNA, 3051 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccatcgacaactccatgaagatcccgctgtacagattcatcaccacgatctgtgccatcattggcgggaccttcaccgtcgccggcatcctggactcatgcatcttcacagcctctgaggcctggaagaagatccagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360631 - DNA, 2703 bp, Homo sapiens
tcagcaaagcataacacgagaaatcagtttcaactggagaatgggtcttggggggcaaggttagtccttctgagcaagaggcatttgaaagatgcttggctataagcaaagtcagtctctcagaggggagggagggggctccaggaagggctgacacaggcagaactgcgggatggcactgaagatgcacaccaggaaggcagttcagacaacaggctccaactcagggaccactgtgccctaaagttccatgttccaacagttcccaggctagtccaggccactgaccacagcccatcagaccacccagggtcccaagcacacaagcctaacgctgtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360632 - DNA, 2426 bp, Homo sapiens
cagtctgaacatccgtttacccaatctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360633 - DNA, 2901 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctaccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggatagctcaagtctctgccatttgtaatttttggctctaagctccgattggagacgcttctccttgtgcatgtgagttgactgatgttgtgagtgtaaatgcatttggttatttctggtatcggtggccacttggatggatttttttacattctgttccccagttacaggaaggagtccctttggtgtgtgaatatgtgtgcctgtagagggtggggcagggtggggtggggatggaaatgtgtggcatgcacatgagttgaaattcttttatgcatttttttgaagaaaaaaaaaaaaaaacaactctgaggacataggggatgtcagtttcctatggaagagacacctctgacccgttattcttataatcaaaatctgaagggaaaaaaatgttttagttctttccccactcgttgggttcaactagattaaaaggctgattttcagaaa

SEQ ID NO: 360634 - DNA, 2336 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctctgcttcttaaggaaccagaaaagggagagggaaccaacca

SEQ ID NO: 360635 - DNA, 1728 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcagaagatttgtcactcacttacgctgtctggcagctcagccctgatgttggcgatgctgtgagactcga

SEQ ID NO: 360636 - DNA, 882 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggtgcgttggcccaacacggtgcgtggcccaaccagtgcgtg

SEQ ID NO: 360637 - DNA, 1473 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccctaaccagtgggaaggtggacccagccccgtccagacccagaccctgacggagaaggaagaaggcttgtcccggggcacagcagacgcacgcacgcagtggataccagctattaccattattgttgctctcatcacagccacatcatcatccttagtggaactaattacctaagatcccacagggagctatggcagaaccaggatctgttctgcctccaggtcgcaccgtgagaacaggtctgtgggtggcccagtcagctgtgaccacatggctgcctcccccacacctcactctcctcctgctcagactcctcccatcgacagtggctcctcctagagtcctcgccctccttagctcctggcaccttggcccagatcaaagagaaccgcacatctccacacgcagacaggagagcacgcatacctttcgtgcacaccaacacacatgagctcacatggccccagacacgtgcacagaatgggcccgggaggcctgtgtgctcaagcagacctgcagacccactgctgcacagggtacctggatttttcttatttcctcacctgagctcaccttttaacccacatcttttcttattatttcctgaaatgcgtttgctctcccattgtcagggatccaaggcaaagaaaacatccctctgtgacctgcccccccgacaaatcgaacctcatttttctgtgtccctgtgagtccttgtccataagcagaactca

SEQ ID NO: 360638 - DNA, 847 bp, Homo sapiens
cgggcgggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaagtctgtgtcacaggggcttggccaaggccagattcttgtctgctcatctccccagttccggcatctcctgaaggactggcgccatgtggccatcagcccaggctgcggaggtagatggcatccaggcatcagaggagggagcagtgcgtccaacagacgtgagctgagactgcagctctcgacatgtgaccttagcaagtttcttcactgctctgagcctccattttcttttctgtaaaatgggaattatcagatgacaaagtcaaaggattca

SEQ ID NO: 360639 - DNA, 636 bp, Homo sapiens
ccgtgttatgaagttttgcccaatggaatgtggtgaaagtgatcatgtagttgttttaagcgtaacctttaagaagtcttgcatgcttccacttgcttttctgggatcctgctcagctgctatagaacaaacctgggctagcctactgggagatgagattatgtggagcagcagtgagccatctgtcttagaatagccgacacttagccaacctagcaactgggggaaaatatgcgggaatgagtccaacagagaccagaagaattgcccagcggagcccagcccaaatagccaatctatagcattgtgacccaaataaatgcatgttgttttaagaccaaaaaaaggaaaagagaggtggggtgcagtggctcatgcctgtaatcctagcactttgggaggttgaggtggatgggtcacctgaggtcaggagttcaagaccagcatggccaacatggcaaaatccgtctctacgaaaaatataaaattagccaggcgtggtggtgaatgcctgtagtcccagctactctggaggctgaggcaggagaaccacttgaatctgggagacggaggttgcagtgagccaagatcacctcactgcactccagcctaggtaacagagcgagactctgtctc

SEQ ID NO: 360640 - DNA, 355 bp, Homo sapiens
aggaagattattcagcagaaacaaacccttcctctgatgagcagaagtggtggatgtcagtaatttaaaaatggaaaatcaagtcattcagaatactttttatagggataatcttttaaaattgcacactgagcatttaatcaatgtaagtaatatggcaccattatctaggttgcacatttgtgaaagcatcagtatatgatgcgttccatggttgggatctaatgatacccagatcaagccatgacataactagtgcagtgtgcaagattcaagccctattcagtcagaattcttcctttgaaatgaggattgacaattaagctttttttttttttttttaaacggagtctgg

SEQ ID NO: 360641 - DNA, 550 bp, Homo sapiens
ataaatgtgtaaaagtccccaacaagccagatgtctttcaatgggtttatgaataaagaaattatgatgcatccacaccacgggctactcttggcaataaagaggaacacactactgttacacaagaatgtggatgaccctcggaagaagtcaatctccgaaggacacatactgcattatcaaatttatgtaaatttgtgaaataacaattatagtacagaacagattggtggctgccagggattggggcagaaacaaggtgtgagtataaaggggtagcatgaaggagctttgtcactgtgacggcagttacatgaatctgcatatgagctaaaactgcacagagatataaacataggcacactcacatattaaaacaaacttcataagtagacccagtgcattatgagttgttacccttccctcctttttacaaaagaaagatctaaaaaatccttttacctgtattgcagttggataggccttcttttgtcaaatcaattatagaatcaagtttcttctgtacagcctaaaaaaattgtaaaaaaaa

SEQ ID NO: 360642 - DNA, 207 bp, Homo sapiens
tatgatttttgtcattttgaggattttatatcagtaggatcatactgtacgtgaccttccaagactgctttttttcacccagcgtaacgttcttgggctccacccagcttgctatgttgcctcctttttcctgctgagggctagcccgtggcacgggtgcaccagagtttaactgttcaccatgatccccacatcatgttttcatag

SEQ ID NO: 360643 - DNA, 598 bp, Homo sapiens
agcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgaggcaaaaagggagctttaaatattgctcagtggcccccatctcccctcttcccacatttactgaggcacgagatgggatgggacctgtcccgggtcacagcagcagtcgtcagcgccttggccctcctggcttgtaggatgctgcttttcctgggcttctggcagtccaggccaggatgggggagccaggaattcatgttgtcattggaaaagctgataaacaggagcacaattc

SEQ ID NO: 360644 - DNA, 1246 bp, Homo sapiens
actgctgcacaggcaaccaacatacttagtgcccagagccttctctctgggcccaggactcagtgatggggccttacttagccctgcctcctgggtggggtgggggagctgagggatcgtgaggacaagaggtagagggaaaagaaaagaagatggtgtttgaggataggggagggacaggagaggggacagaaaggtcccagagcatgatgatgaaggaaagggatctggcattcatgaagcacctacgatggttcaggcacaaacactgaaacctcaaattggccctggcagaaggggaccatcatagcaaggtgggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaaaaaaaaaaa

SEQ ID NO: 360645 - DNA, 1407 bp, Homo sapiens
agcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcatgatgatgaaggaaagggatctggcattcatgaagcacctacgatggttcaggcacaaacactgaaacctcaaattggccctggcagaaggggaccatcatagcaaggtgggggggggggtgcagaaagtgagtttctgtttcaagaacagacttcactagttcagagttgcacagctagtgaggtatggagctgggctttgaatcaggtcagctgcctgaatgcccaacttcttcagcccttggaaggagagggtggggagaagaagaaggaaaagacaaggaagaaagaaagaagagagaaggggagaggaatggaagtccaaagagtgggaggaatttgatttcagaaccatctccagctgacccttgagccagcaaggacagggagaagggaagagcaagaacacgaagggcctcaagcaccgggatgcctttgccagccttagataattcccagagcgcacagagccctgcaggttcctgggtccttctccagagaagaggcacagagattctggcagcaaggttcagaaggggtgaggaaactgggcactgacaaagggaggggattggctcaaattcgaccccagagtcagctctggtggggttgggagcctggatgggtgggagaagatagaatccaatcgtgaaaaccataagggaccttcaaactcatcttgcccagatgtctcccatttcacagatgagggaactgaggttttgagagcttcccctgaggactctgcaaaacgaggtggtgtctggtttggatgaaagtggtcggtgattcctcaactcctgccctgcctccctctctcgttcctccctaacatgttatgctcttgttggggctgggatgccctaggcccaaggttaccaaatcctgggtttggaaaattgctgctgggggtggtatctaggaccagagaggaatctactatttctactgtgaaataattcagcagggggtcttcttacttcttccctttgaggacaaagtttctctcgaataaagagactgaagcaaaaaaaaaaaa

SEQ ID NO: 360646 - DNA, 3657 bp, Homo sapiens
aaagatgcttaaggaaaaagtgtgaaataaggctttcatatcctgcataactgacttaatcggggcacagactattagcagaaaatgctattccagtgaaccatgaggaatccactagacagagagctttataaccagaataactagagacatcaatttaaagactgctgatttaaaagcagaaagaaaaaaaagctgatttaaaggcaaagtaattaataaaactaactaattttgtctgcccaagttcttgcagtttggaaataatacttccatggaattttactttcacaaacctggagtaactacatgtactttaaagtaacaaattatacgccacttagcgattctgcagtggaattgatgatgttaacctgttacttatatagagctttatagtatgcaaacagatttatgtctttctgtcttttgaactaactgaattgcttttttaaaatttccagttaacacctgttacaaaatcacattgaatgcctttggttggttctctgctccatcgagtctgctgttttctgtgaacacaacaccatcttactctttgtctcctttgcctgtgaagtcctgattactgctttcttcacctggttaaatcctgcttatttcttatttcccacaaagccatcactgacccttttgctaggctagagtagtgtacatttctgtacgctacatacttcattagatgtacttttctcacccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccaggtgtgtctcagagcctatacacttaatcaccacactatattggctaagagagatgcaagcaatattgatggttcatggttggtgatcaaaatagtatctgtcaaccaactattctgatactttttttttaaatactaagtttaatccaggacattttagtcccaaatttggatattaaaggaaaactaaatatgttacctgcaaataaagttttgttttccaaaaagaaaattattaaagggcacttcaacactgtgactttaagtactagaaatattttagtaaaaacagactaaactgaaacattgagcagtgaatcctttaaagagcaaggttataaggttttaattgttactttttttcctgcttcatttgcctgtaagtgactttattaaaaaacctaagtatatatgtcatacatttacccaaggaaagtgtacaaactaccttgaatattagacatattgatttttggctgtgtgcctgtgtaattatcttaggagaaattctttgtgggtaagtggggacatttttacgataatgtaatttcttgaatagccagctcttcaaaagctatttgtaaaaaatatttaaaagtttcttagttatacaaagttaggaaccactgttctaggaactggaattgtgttatttttattcctctggaggaaaaatgagatcttcgtaatgatctctttaaattgactatttagaaaagttaggagttcagagaagctttcttcaattgtgaaaacaatacaaaatagctagctgattggaatgcagaaaaatgcagattaatcaggataccattaaacatctctgtttttccttcctttcttgtagtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttc

SEQ ID NO: 360647 - DNA, 4300 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360648 - DNA, 3661 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactg

SEQ ID NO: 360649 - DNA, 3256 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcat

SEQ ID NO: 360650 - DNA, 3424 bp, Homo sapiens
  misc_feature (3281)..(3282): n is a, c, g, or t
  misc_feature (3289)..(3289): n is a, c, g, or t
  misc_feature (3294)..(3295): n is a, c, g, or t
  misc_feature (3307)..(3307): n is a, c, g, or t
  misc_feature (3316)..(3316): n is a, c, g, or t
  misc_feature (3318)..(3318): n is a, c, g, or t
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcattaaaaaaaaaaaaaaaaaaaaaaanntgttggnggccnngcccgaaatttnaaccctcgntngggccgcccgggaagaacttccaagtccgaaaccggccgccggctggttcccaaaaagccggccggtctgaaccggggctggtcggtcccgccgtaccccgggggg

SEQ ID NO: 360651 - DNA, 3256 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgattgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360652 - DNA, 4416 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaaatgacagtggtctctggccgggcgcggtggctcactcctgtaatcccagcactttggtaggctgaggcgggtggatcacctgaggtcaagagttcgagaccagcctggccaacatgttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360653 - DNA, 4163 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaatttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360654 - DNA, 4738 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattggttgtgaattcactccttaaaccaaaaaccaaattcttacgcagaatgaagactgctaagggaaagctaaaggcatagatgttacctttttaagaaacacattttggaacctttgtgagttatttcattgcttgagtcagctatcctcaaccctttattgcttgagaatgtttccctttgtaaaagagattgctaaaattacgtgttctaaagcactctgtttagagttagagttgcctatgggaaaagcagcatataagcatcctcgattcagagaggctgatttcgtccttagacgttttccccgttctgtcttaagatgacagtggtctctggccgggcgcggtggctcactcctgtaatcccagcactttggtaggctgaggcgggtggatcacctgaggtcaagagttcgagaccagcctggccaacatgttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360655 - DNA, 4961 bp, Homo sapiens
aaagatgcttaaggaaaaagtgtgaaataaggctttcatatcctgcataactgacttaatcggggcacagactattagcagaaaatgctattccagtgaaccatgaggaatccactagacagagagctttataaccagaataactagagacatcaatttaaagactgctgatttaaaagcagaaagaaaaaaaagctgatttaaaggcaaagtaattaataaaactaactaattttgtctgcccaagttcttgcagtttggaaataatacttccatggaattttactttcacaaacctggagtaactacatgtactttaaagtaacaaattatacgccacttagcgattctgcagtggaattgatgatgttaacctgttacttatatagagctttatagtatgcaaacagatttatgtctttctgtcttttgaactaactgaattgcttttttaaaatttccagttaacacctgttacaaaatcacattgaatgcctttggttggttctctgctccatcgagtctgctgttttctgtgaacacaacaccatcttactctttgtctcctttgcctgtgaagtcctgattactgctttcttcacctggttaaatcctgcttatttcttatttcccacaaagccatcactgacccttttgctaggctagagtagtgtacatttctgtacgctacatacttcattagatgtacttttctcacccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccagtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360656 - DNA, 2420 bp, Homo sapiens
aaagatgcttaaggaaaaagtgtgaaataaggctttcatatcctgcataactgacttaatcggggcacagactattagcagaaaatgctattccagtgaaccatgaggaatccactagacagagagctttataaccagaataactagagacatcaatttaaagactgctgatttaaaagcagaaagaaaaaaaagctgatttaaaggcaaagtaattaataaaactaactaattttgtctgcccaagttcttgcagtttggaaataatacttccatggaattttactttcacaaacctggagtaactacatgtactttaaagtaacaaattatacgccacttagcgattctgcagtggaattgatgatgttaacctgttacttatatagagctttatagtatgcaaacagatttatgtctttctgtcttttgaactaactgaattgcttttttaaaatttccagttaacacctgttacaaaatcacattgaatgcctttggttggttctctgctccatcgagtctgctgttttctgtgaacacaacaccatcttactctttgtctcctttgcctgtgaagtcctgattactgctttcttcacctggttaaatcctgcttatttcttatttcccacaaagccatcactgacccttttgctaggctagagtagtgtacatttctgtacgctacatacttcattagatgtacttttctcacccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccaggtgtgtctcagagcctatacacttaatcaccacactatattggctaagagagatgcaagcaatattgatggttcatggttggtgatcaaaatagtatctgtcaaccaactattctgatactttttttttaaatactaagtttaatccaggacattttagtcccaaatttggatattaaaggaaaactaaatatgttacctgcaaataaagttttgttttccaaaaagaaaattattaaagggcacttcaacactgtgactttaagtactagaaatattttagtaaaaacagactaaactgaaacattgagcagtgaatcctttaaagagcaaggttataaggttttaattgttactttttttcctgcttcatttgcctgtaagtgactttattaaaaaacctaagtatatatgtcatacatttacccaaggaaagtgtacaaactaccttgaatattagacatattgatttttggctgtgtgcctgtgtaattatcttaggagaaattctttgtgggtaagtggggacatttttacgataatgtaatttcttgaatagccagctcttcaaaagctatttgtaaaaaatatttaaaagtttcttagttatacaaagttaggaaccactgttctaggaactggaattgtgttatttttattcctctggaggaaaaatgagatcttcgtaatgatctctttaaattgactatttagaaaagttaggagttcagagaagctttcttcaattgtgaaaacaatacaaaatagctagctgattggaatgcagaaaaatgcagattaatcaggataccattaaacatctctgtttttccttcctttcttgtagtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtaca

SEQ ID NO: 360657 - DNA, 913 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtaca

SEQ ID NO: 360658 - DNA, 1030 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattggttgtgaattcactccttaaaccaaaaaccaaattcttacgcagaatgaagactgctaagggaaagctaaaggcatagatgttacctttttaagaaacacattttggaacctttttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtaca

SEQ ID NO: 360659 - DNA, 2150 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttc

SEQ ID NO: 360660 - DNA, 4247 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcatcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcacttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaaaaaaaaac

SEQ ID NO: 360661 - DNA, 840 bp, Homo sapiens
tggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctggtaagctactctgaaagtgggtccga

SEQ ID NO: 360662 - DNA, 505 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgggtcggcgctttgcctgatgaccctacctctctgacagatctgagaagagtttactcttcagcttttaagtgaataaagatgataaatgtcctaaaa

SEQ ID NO: 360663 - DNA, 5254 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaaaaaaaaaa

SEQ ID NO: 360664 - DNA, 2209 bp, Homo sapiens
ctcctgtttgattatcatttttgccttttctaaaattaataggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattca

SEQ ID NO: 360665 - DNA, 1872 bp, Homo sapiens
taaatgttccagggcacacagaaaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattca

SEQ ID NO: 360666 - DNA, 2073 bp, Homo sapiens
ctccatagagatgaatgcatatgattttcaaaacaggagaatttaatgtcaccatttttaatattatttggcaagcactggaaaaaacctagtgtgggaaagtagtgtaacactaatgaactgtattataatgagtaagcttgggtatgagcagttattgaaaataatattgagaatacataaatttatggcacaataactgcatgtattgattcttctttacaaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattca

SEQ ID NO: 360667 - DNA, 1935 bp, Homo sapiens
aagaatacagtcgatgaaactcaacatgtgctgtatttatttaagtttcatcgactgtattcttttcaagaaggaaagtaaaatcaaaatggaaaaacacagcacatgttgagttttctgccctaagtgttaaaattctatgttttttaatgcagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattca

SEQ ID NO: 360668 - DNA, 5419 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcatcattctaggccaagtgagaactcctcagttccttgggacatctccacctctaaagaggaaaatttatccacagttgaagaagaaactgattacaaatcaccatcagctgatgacaaagggcagccatctgaccccagccaatctagtttcacaggtcttttgaagagaatggaacaaagaggtgttataaaaagggtgacattacaatctgaagcggagtcatgtgaagggaaacctgattgtgtgacttctaaaaaacgtttggttcctccattgcatcctcttctgagaattgccaccactgaggtttttaaagaccctgctgattgccatccttcttccttcatgggacacagggtatatcctgtggccaaggacacctctcctttccaaccaaacccaccagctgaaggccccattgtagaagcattagaacacagcaaaagaggaaacacaacatcccctctagattctacctcaaaagaaatggaggtcatgggttgtaggttttaccacgctgcctccattgcagcccgagctgctagctacatggcctatatgactcaatatcagcgtaaactctgggaagacatggaagatctggttcatgacccagaatttgatcgtggaaaagcaagatgcataatatctgatggtatggatgcaggcctttggcaactttgtactactagggacataatggactctgtagtcagagttatggccatggccatagactatagacggcaggcctggcttcgacttacatctctcactaagaaaacccaggagaagatctcccacttgccctttgatggtacttccctttttggacaagatgtgaaagctgttgttgcagaagacaacaatataaaagaaaatgactataaagatcacaaatactataatcagcatcgatacttttatagtcatgatcagaaagcacattatcacaatagaggatactccaaaggggattggtacaaacctcgaaaccacccctatagatatagaaagaagggagactctccagaacgccatgggtacaagaattaataacctgtttaatgttcagcagagtagtcattcaagatcctaactattttacttgttcctccttgtacaaataggatctacaggtaggagatcatctcaaaaactggatgcatgtctggaatgatcacagctgacatttgaattctagacttttgaaatgaagtatataataaagaaactcatgacttggccaagtgagcagtggagactttcttgaaagggttggacaaatgtttatcctttatttctggtccaaaaataagtgtggaggaggaccactcaggaatctgaatcctcttgtgattaaagaaaaatataaagatgtgttcctcaggaaaatcttatttgtaaactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaactttgatgtcttgcatatattgctggtggtatttatgtgaattttgtacagtgatttaatcttgtagtttatcatttgtacaattgcactatctaaatgtactcccttctgaatgttaatttgttttctttatagcactgttgattcatttcagaaggttgtagagtatacctccctcccccttatttaactaact

SEQ ID NO: 360669 - DNA, 2703 bp, Homo sapiens
  misc_feature (2703)..(2703): n is a, c, g, or t
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaacaaacacaaaaaacaacaaaaaaaaaaaaattgttgtggggcgcgcccgcggccccggagaaaaaagttcttttaaagagacccttctcgtgtgggggcgcgcgcggcgcccaagttgtggtgtattgtggaaccctgtggcgccaaaagcgtgggtcccaaagagaggagctcgctgggggccagagcacaacgtggcgctggggttttcctacccacaaaggaaaaaaagccgcgcggggggacacccacagggcgggtttcgtgaacacaactccctagggaggggcttccgagcgggcccataagcggcggcgtcatcaccgcggggtcgcaaggagggtcagataatattacgcgggcgcggggggggggggn

SEQ ID NO: 360670 - DNA, 1037 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggtaagtaggatattcataatagtgaatgctgaagatctagtgagctaccaagtgatttcataaaatgaaagcgtaatgctcctttgccattatgattatatagctttatattccaaactcaaattattttgtgccattatgatataattttttcataattgatgaagtcagatttttctagtgggtgtagctttcagctttatgggtatagcttttaaatatttatttttccctgatacag

SEQ ID NO: 360671 - DNA, 677 bp, Homo sapiens
ttcttttcctctccggcgaggggcggtctcggggcggacccgaactacaattcccagcatcctgcgcggcgcggggaaggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggaggtgagtagtcgagtgagggtcctggcgttctcagaggcgaaccgcgaagggtttgtgttttctgcggtctgaggcctggtgctccgtcgcagcctcggggcgatacctcttcagtgtcttgggccgagcccagctctggggcctggtgcgtgtctgagcgaggaacccgcagcaacaatggccgcccggccccccgcacgggccctggcgttcgttgtggccgcggctgggccagtgggagcgacgttttaaggcaggattgcccttcggtgttgagcttgcgttcctcctggagtagataaggggaattgtgagaggctggtaactaacgcgttttcagcgttgggtccctgc

SEQ ID NO: 360672 - DNA, 5143 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattca

SEQ ID NO: 360673 - DNA, 5394 bp, Homo sapiens
gcatatcttgagtagaacttaacatatcttgaatgggatatttttttcttttattcttatgagtggtctcacacaggaccaaacagcaggccagcatagcaccacgtgatctgagcttgtttttactctctcctttttcataaacagagtcccagattaatgccagtagttgattttgggtctttggggtagtgaagcttgtggatttgacttctctgattccttttgctgaccttgagtggattgtatctttcactgttaattataataatttaaaaattgagttctacttactggacatgaatctctgcacttgaaagttaacatattaaaagcatattttttttcttccttggttttcttgttcatgtggataacccagagaatgcctgaatctaaggtgccatcctctgagaatcatcgcccagaaatgtgctctagctgcaatgttcctcttcccattggagatagcagctccttctctgggagttgttccagcagtccagaaaggatagtttctcaaacttcctctgttgagaacccattggagaaccagaaaaatgatcaaaataattcagatactaagatctctgagacagagacccttaaatcatcacagaattttcagactctgccttcatctccacttctggtcccccaagaatctttggcctcttctgaggtcaaagagaatttacgtatagattcttcttcagcttcacagcatggacgggatgccatcctctatctccagacacaagtagctgaaatgtcccgagtgatacgtgatctgcagtccaggagctgttttagatttcatcattctaggccaagtgagaactcctcagttccttgggacatctccacctctaaagaggaaaatttatccacagttgaagaagaaactgattacaaatcaccatcagctgatgacaaagggcagccatctgaccccagccaatctagtttcacaggtcttttgaagagaatggaacaaagaggtgttataaaaagggtgacattacaatctgaagcggagtcatgtgaagggaaacctgattgtgtgacttctaaaaaacgtttggttcctccattgcatcctcttctgagaattgccaccactgaggtttttaaagaccctgctgattgccatccttcttccttcatgggacacagggtatatcctgtggccaaggacacctctcctttccaaccaaacccaccagctgaaggccccattgtagaagcattagaacacagcaaaagaggaaacacaacatcccctctagattctacctcaaaagaaatggaggtcatgggttgtaggttttaccacgctgcctccattgcagcccgagctgctagctacatggcctatatgactcaatatcagcgtaaactctgggaagacatggaagatctggttcatgacccagaatttgatcgtggaaaagcaagatgcataatatctgatggtatggatgcaggcctttggcaactttgtactactagggacataatggactctgtagtcagagttatggccatggccatagactatagacggcaggcctggcttcgacttacatctctcactaagaaaacccaggagaagatctcccacttgccctttgatggtacttccctttttggacaagatgtgaaagctgttgttgcagaagacaacaatataaaagaaaatgactataaagatcacaaatactataatcagcatcgatacttttatagtcatgatcagaaagcacattatcacaatagaggatactccaaaggggattggtacaaacctcgaaaccacccctatagatatagaaagaagggagactctccagaacgccatgggtacaagaattaataacctgtttaatgttcagcagagtagtcattcaagatcctaactattttacttgttcctccttgtacaaataggatctacaggtaggagatcatctcaaaaactggatgcatgtctggaatgatcacagctgacatttgaattctagacttttgaaatgaagtatataataaagaaactcatgacttggccaagtgagcagtggagactttcttgaaagggttggacaaatgtttatcctttatttctggtccaaaaataagtgtggaggaggaccactcaggaatctgaatcctcttgtgattaaagaaaaatataaagatgtgttcctcaggaaaatcttatttgtaaactgaggactagcagattttgaatctagaaataatactagatgtctgtttactaagaccagaggtaaatccttaacttttaggttatcagtgcttccttgttcaggcttcagtttgacagatcttcacaaaatgacacatctgttaaaatgtctttatgtcaagatggtcaactcaccaagagtccgtactactatcaagctctgtgagacttcagaatcagccatgaagctttgtgtcaactggaattcaaatcaaattttgccaaatccagtttgcttccccttggaatggctagatgtcgcaggtctattatggacaccaactggaaaaagacttctacctgtaacatctctgtagaaattgcacagtaactatcttcatcaagactttgatggccaccataccatcactactcataaagctacatgtgagagaattgtttgttgttatcaatcctaatagtctttgacctatcaagctctcgtatcaagctgtaagactgagtcatggtagtctctcactgtaagctgggcctttcaccaagatggccttcttaaacaacctaccttctaaacatttaattcttttgagcttgatagtgcatcacactctaaatacaaaaaagatacgcacatcagtgccctggaaataaaggatgttacacgatccaggcatgcaaatctgaactcctaagaccaagaattccaaacatgcctgacaatcttgtccccttattgtaataaagagggataccatcagtctagattttattgagaatccttaagatttaaagcatagctgtggatgtggtgaagagaacaagccacacagctctgtttctggatatctaagtgatgatatccattaatgatttgaaaggctgaaatcaagatttaagtgatacgctcttggttaattggttacttaatttagtcagattcttagtgtaagagacagcttatctttttgctcccaattggtcccattaatagtttttcaccatactggaactggcagcagatacctcaattatatgtcccacagtatcttctctttagactcaaggtagtggatgtatggtatatcagcccttagatccatgtcttcacagcatgacatcaggaatggagaatatgtcaaatttgaggggtctgaatacatcacctagtattatttgcttggcagccaaaaacagttgtttttattgacagacttaattctgtaacttctgcgttttttcatctgcttgatcaaggcattttggatgtactgctaatggaatatggcactgttttacggtttatgtggcttctgttcttgccacagttgttgcacagtggtaattgatgttttctctggtgccacactttttaataatctattggaagctcattcctcctcccccatcataaccatattcagcacccatttttaaatctacttttcttccttatttgtgctacagaggttgatggcgtaaattttcctacttggaagaaattactttatcagttaatttcagggtactgtattgatcttgtttgtcctatttgtagattaaacttgaactagtcttaataaaggggatattgttttgcaaatttagcccagtcatatcaagagttaatatttatcttatttttctgtattttactcaaaattttatttccacttctgtagaaataggtccatgccagtgttctctacaaagtgtctttcaaactaaactctagaagaatatcgattacctgaacagaaacaaaggcctaagaaatcatacatttttgtagcttatgtgtattgcaccaatcaagcaatcccatgtgctcttgatattggcactgtagttttatcttagaggacttgccactggagaactcagtggtgagagaccttggaaatgttttatgtggctgcacataagtgtttctgactagctaaggctacttcagacttttcactttccatttgtccccttttccttccctgaattagatgctatgtcataaacttggtggtttttgaaatactcttatttcaaaccttaaactaaaccgaaataagttatgcctgagaatgcgtttgtctgaaacgattttggcacttccctttaatatgcttccccttccctttgccttttaaattgtggttaaaaaaaaagaaaaaaaaaggcacataaagctgagcaccttaaccattttttaagcgtatggtagtgttgactatatttgcattgttgcgcagctcctccattcttaaatatttgtaagatgatgttgctgttctcttttcctcctgtgatatttatgttgcccagtaataagtaaaagtatcctttcttagttactctaactgatatgcccaagtgtctccagatactctgttttcctggaagtgtaaaggtattgggaaattatcaaattggtgaccaagtagttctgaaaggatttgaccgtttaatagggatggggacagaatgcagatcaggaagagtttttagtaatagattagtttcttgattgcaaaagaaatatctttaatgtgttaattttttattattttaaaatctctggcatacttgaatgataatgttataaaacttaaagtgaggatttggtctagggagattaccccaatagaatcagaaactcttagtcagataataaatcctcatattatgcctgccatgttcagaacctgcaacaaaattccctactaggccaacctctaacgtttaaatacctctaggttttctaggaggccttggaatagttgcaagtttaatgatctggtattctcaaaaaggatgtatctaatgatcttgattcttcaaaatgttatttcttgattagatatacaatgtatatagagacaatatggtttcttgtagttactgtgtatagagaagtactgtttccatttttatatgaagtgcctttttaattctacacttttctttaaaacttaaactttgatgtcttgcatatattgctggtggtatttatgtgaattttgtacagtgatttaatcttgtagtttatcatttgtacaattgcactatctaaatgtactcccttctgaatgttaatttgttttctttatagcactgttgattcatttcagaaggttgtagagtatacctccctcccccttatttaactaact

SEQ ID NO: 360674 - DNA, 1020 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgtgccctatacaacaggattcttttgttccagaaccacatgaccacagaaaatttgttttctcttagaaaaaaggatatgtagagatccttttaggaatggaaagtgggggaagggtttataggggatatattacttcagtcatcatccctttaaccttgtctgtgccccacatatttggagttatttatcttacctgtgatgtactggttgtaggtttgacccttggaccaatacttcccttgctctgagaattgaactagttgagccctttgtaacagtcttgcctttcatttgtccttgctttagcccaaacttctgttaatgagctgttttcatcttggattagaaaactcttagttattgttcagagtggccacaaacttcttgctctgtgatataggggattgagacttggacttggaatcagaatacctgggtttgagtcccagctttactctttacaaattctgtgactttggataaattaagtaaccttttagcctccgttttttaatcaaataatacctacctcacagggttgttgtgaggatgaaatgaggtaacaaattataacttcttataactacaaaccataaagtaggactatacaa

SEQ ID NO: 360675 - DNA, 5232 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaaaaaaaaaa

SEQ ID NO: 360676 - DNA, 4246 bp, Homo sapiens
gatctagaggatcccttaaaagtgcactcttctatatctaccatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcactgatcgtatttctacttgttaaataattaaaaatcatcttaaaattcatactttgactttaatttagacacaaggagatgtaatcgctgtgtaacatcagagaaagctatatggattatcgtcagaagtaaatgtttctaacattgacaaaaaaaaaaa

SEQ ID NO: 360677 - DNA, 5243 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaagaatgtgacagtgatgataacatgggtgccaaaaatacttcaataggagaagaatttatatccacagaagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttgcataaaattatttttcataacagtccttttttatatattggtgtaaacataatattcttcaagaaataatgttgaaagcctactcaggaataatcttccttaactctttaaatttttatttcatgtgaagtgttttcagtttagttattcactgaattgtcagtttccttcatttggtattacatatttaattcttaaatattgaggccccattgtgagtaataaaaaatacgacataagtagaagactaagaagggcttgtcatattatctttgtgtatatgcttcatgttatttaaccagaaatgtcttatctctaaaaatttttagtagtaattatttaccaaacttaaaaacatttctataaatataaagcttttctttatatttaagacaaaatataaaggctagaatttggttccttctctgtaacactaaatattttagtgtgaaattgaatttttttattactatagtcttttcaatctataatttgtgtttttaatttcttgatatgtcacttctgttcctccctgcttgcattttttaaaaactagacattgtggcttgagaatttatcaatcatctttccgaaatgaccacattgtgcttttagtttgtatgtttaagtggtcaagcaaggctctaggaggtagtcactgagctggaccttaaacacatctgcaggagctcacaaaatgggagcaaaagaggcattccagaaagaagagtagttaagcagatgtgggggcagggcaagaggagacagcaccttgttgccagagattctacacaaaggtgtgatggacactgatgctctattaagaagcttttgtggtgtgtgtggtagagaataattaaggcttctgataagacaggaaagggatatttcatcatgactgttaagaaaaggtaactgggttgtttaatgttttaattgataattgtcaatacgaatggggagaagaagaagcaaaaaagaaagaaaaaacacttattagaagccctagtcattttttggctttctgttttgttgctgtccattgaagactttgaacatgccgccttaataaaagattagaaggttctaacattgaca

SEQ ID NO: 360678 - DNA, 3764 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaactttttcccacctcttagaatatagttcagtttaaaaggctcctcttaaaccttcctggatagaacataggaacataattggaatattgttcttttgtattatagttactctgctagaatcgttttctttacatgcctctgtggtaaatgttagctctatctggtgactcaaagtttatggatcttttggccgggcgcggtggctcacgtctgtaatcccagaactttggaaggctgaggcggacggatcacgaggtcagaagatcgagaccatcctggctaacatggtgaaaccccgtctctactaaaaagaaaaaaaaaatacaaaaaattagctgggcgtggtggcgggcccctgtagtcccagctccttgggaggctgaggcaggagaatggtgtgaacccaggaggcgaagcttgcagtgagctgagatcgcaccactgctctccagcctgggcaacagagtgagactctgtcttaaaaaaaaaaaaaaaaaaaaaaaaaagtttatggatcttttgatacagattgaaaaagcctttattcaacacctaaaatgtgtcaggtgctttggctttgtactaacatggttactgattattatggttttatcccttttaaaatacaaagaagcagatgttttgtttttgtttttgttttttttccctcaaagttttaaaactaataaatagcagaattatttggcctctcagctataggactaatgttattttcaacatgccataactgcctcttcg

SEQ ID NO: 360679 - DNA, 3750 bp, Homo sapiens
agcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagacccggggtcggagataatagaatctgtccctccagctggccctgaggcatctgagtcaacaacggatgaaaatgaagacgacattcagtttgtcagtgaaggaccattacgacctgttcttgaatacattgatctggtcagcagtgatgatgaagagcctagcacctcttatactgatgagaatattaaacgtaaagaccatattgattatcagaaggataaagttgctttaactctggctcgtctagcccgccatgttgaagtggagaaacagcagaaagaagagaagaatagagcattcagagaaaaaattgattttcagcatgctcatgggttacaagaattggaatttattcgaggacattctgatacagaagcagcaagactgtgtgtggaccagtggctaaaaatgccaggactcaaaacaggcacaattaattgtggaacaaaaagttcattccgaagaggaggccacacgtgggtgtctgggaaaccaattttatgtcctataatgcactgtaacaaggagtttgacaatgggcaccttctcttaggacatttgaaaaggttcgatcactctccatgtgatccaacaattacactacatggacctttcttcagctcctttgcttgtgtagtatgttataaaaaatttgttactcaacaacaatatagagatcacctttttgataaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtgataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcagagttcattgtcgaaatgctggacctgtagctgtagctagagaagagtgcattacccaggttgcagagaaattcatattaagaggttattgtccagattgcaatcaagtctttgtggatgaaaccagcacccaaaatcataagcagaattcaggacacaaagtccgagtcattaactcagtggaagaatcagtcttactctattgccacagcagcgaagggaacaaggatccttcttctgacttgcatttattgttggatcaatcaaaattttcatcacttaaaagaaccatgtctattaaagaatctagctcactggagtgcattgccattccaaaaaagaagatgaatttaaaagataaaagccatgaaggtgttgcttgtgtccagaaagaaaaatcagtagttaaaacctggttctgtgaatgcaatcagcgattcccaagtgaagatgcagtagaaaagcatgttttctcagcaaacacaatgggttataaatgtgtggtctgtggaaaggtatgtgatgattcaggggtcattcgtttacacatgagccggattcacggaggggcacatttaaataactttcttttctggtgtcggacatgcaaaaaggagttaacaaggaaagatactatcatggcacatgtgactgaatttcataatggacacagatatttttatgagatggatgaggtagaaggtgaaactttgccatcatcctctacaacattggataatttgactgctaacaagccttcatcagctattactgttattgatcattccccggcaaatagttctccgaggggtaaatggcaatgccggatttgtgaagatatgtttgattcccaggaatatgtaaaacagcactgcatgtctttggcaagccacaagtttcatagatacagctgtgctcactgcagaaagccttttcataagatagaaacattgtaccgacattgccaagatgagcatgacaatgagataaagattaaatacttctgtgggctttgtgatcttatctttaatgtggaagaagcatttctgagtcattatgaggagcaccacagcatagattatgtatttgtgtcagaaaaaactgaaacttcaattaaaaccgaagatgattttccagtaatagagaccagtaaccagttaacttgtggttgccgtgagagttacatctgtaaagtcaacagaaaagaagattatagcagatgtctccaaatcatgctggataaaggaaaactgtggtttcgctgcagtttatgttcggcaacagcacagaatttaaccgacatgaacactcatatccatcaagtgcacaaagaaaagagtgatgaggaggagcagcagtatgtaatcaagtgtggcacctgcaccaaagcatttcatgatcctgagagtgcacagcagcatttccatagaaaacattgcttcttacagaaacccagtgtggctcattttggatctgaaaaatcaaacctgtacaagtttactgctagtgcctcacatacagagagaaaactgaaacaggcaataaactattcaaaaagtttagacatggagaaaggagttgagaatgacctaagctatcagaatatagaggaagaaattgttgagcttccagatttggattacctgcgaaccatgactcatatagtctttgtagattttgataactggtcaaacttttttggtcatctaccagggcatctaaaccaaggaacatttatttggggctttcaaggaggaaacaccaattggaagcctccgctcaactgtaagatttataactacctgaacaggattggatgcttcttccttcatcctcgctgtagtaaaagaaaagatgctgctgattttgccatatgtatgcatgctggccgtctagatgaacaactacccaagcaaattcctttcaccatcctctcaggagatcaaggttttctggagctagagaatcaatttaagaagactcagaggccagctcatatactaaaccctcaccacttagagggagatatgatgtgtgccttgttaaatagcatatctgataccaccaaaggtacgcagctgcagtcacagtgcaaaccacccaagaggaggagacttcactgctgagagaaaccaataaactgctgtccgctagtgaactgttgcctgcttgctaaaccatcatgttctcttacttctatcttacttatcttttttaaaaaaatctcactttcattctttagtgttttagaaggaggatgaattcataataattttctggagctttttttgatctagtagataaaatctatattgatgtatataaaacatatattcatgtgttacagtatgttactacaattttaaaagctcagaattcagatcttcactttgtttctgaaattccaagttgaccttcagttttttagaaagcagtgcgcttagaggtgaaaaccagaaagcaataacaaaggtgatcatttaagaggttgacagtgacaaaataaaacgctgataggcttttagg

SEQ ID NO: 360680 - DNA, 3858 bp, Homo sapiens
agcgtggtgttacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccaggtcctgcacagatgtgaagacacagatgaggtgtcgggccccagcttggcttcggcgtctatgtggacagctgctctctgaaaggttaatgagacctaatggtgttcaggcagtagtccggggcattttggaaggagcaggtgcgggagcagctggtggaagtgatgctgaggtgacggctgctgactggaagaagtgtgacctgatcgcaaagattttggcctcttgtccccagcagtctctttcaccagagaattactacagggacatctgcccccaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattagtgatgaagatgaagatgaagccctgtaccagaaggtatcctctgagcagggccgggtggagcatctcggggacttgctgtcccactgccaggaatgcggtttggcaggagacttcttcatcttctgtttgaaagagttgactcatgtggcctcggaaaatgaaacagagttaaaaactgagcccttctccagcaagagcctcttggaattagagcaacatcagactcttcttgtggaaggccaagagcggaagctgcttgtcctgcagctgatggctgttctgtgcgagagaatgtctgagcagatattcacaaacgtcactcaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatgg

SEQ ID NO: 360681 - DNA, 2264 bp, Homo sapiens
actcactatgctgactctccaaacaataggcagcccttgctgggagagctttagagatggttttcagcatctctgcgttcatcccatcacagggtgactggtttatttgccttttgatcgtaaacagtaatgaatcctttctttttgttttcaaccccaggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttccttta

SEQ ID NO: 360682 - DNA, 4828 bp, Homo sapiens
agcgtggtgttacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccaggtcctgcacagatgtgaagacacagatgaggtgtcgggccccagcttggcttcggcgtctatgtggacagctgctctctgaaaggttaatgagacctaatggtgttcaggcagtagtccggggcattttggaaggagcaggtgcgggagcagctggtggaagtgatgctgaggtgacggctgctgactggaagaagtgtgacctgatcgcaaagattttggcctcttgtccccagcagtctctttcaccagagaattactacagggacatctgcccccaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattagtgatgaagatgaagatgaagccctgtaccagaaggtatcctctgagcagggccgggtggagcatctcggggacttgctgtcccactgccaggaatgcggtttggcaggagacttcttcatcttctgtttgaaagagttgactcatgtggcctcggaaaatgaaacagagttaaaaactgagcccttctccagcaagagcctcttggaattagagcaacatcagactcttcttgtggaaggccaagagcggaagctgcttgtcctgcagctgatggctgttctgtgcgagagaatgtctgagcagatattcacaaacgtcactcaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttccttta

SEQ ID NO: 360683 - DNA, 2639 bp, Homo sapiens
agcgtggtgttacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccaggagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatgg

SEQ ID NO: 360684 - DNA, 971 bp, Homo sapiens
agcgtggtgttacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccaggactcaggcctagggactcttgggggtgactcattaatgataatgtgtggtttgctgtcttcttctggaaaattaaataactttagttccctgttta

SEQ ID NO: 360685 - DNA, 1801 bp, Homo sapiens
ttcacccaacacaggagcctcttaaaaattctgtgtgagttcgtttcagccagtcttgcatggggacattgtcttccgtttcagtcctgacgtccaccctgtgcacctgcgtgatcgccagccctgcctggtccctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagcacgcacacacacgcatattcacgcatgcacaggcacacacgtgcacatgcccacgcgtgcacacagccacacacaccctcacgcacacacgcacagcaccatgtgggaggggttctcggctgtgacagtgaagggcagggcctcacctcggctgctccttgtgagttgtgggccccgtgtctgtgcccggccgccctgcggtgctcaccagccttctgaacgaggagctggacaggatccctggaaggggccccggggtctctgagtcgcgctcagcgggtgcttgtgctctctgcccagctgtgctgaagtcccgagggacatgtccgctgcttgcgggtcggttcctgaggaattggaagtgtcacgagatgtggccctcgttgggctggcgctcattggcctcccttgtgcctgtgcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgagagccgttgtacccggggccgggtgctagcgtgccagagctccgtgggcagcaatggcctctgggccctctgtcctcctcttcgagtgaccggatggctgtgtccgtaggtgaggctcccctccctgcagggtgggtgtcccgaggcctgtgcagggcctgccactgctggatttgtgtcctgactgaaagtcctggacatgggtgtcctgtcacactctgggacagctgggctgggcctcctggaccgacgctggagcccagacctggggctggggctttggcctgccgtcctccctgcccagccaacagctttgctctttgattttcagatgcattttggtttctgcacagtcactcgggtataaagggcatctttgcttttgagcaataaagatgaaggccgggcacagtggctcacgcctgtaatcccagcattttgggaggctgaggcaggtggattgcttgagttcaggagttcaagaccagcctggccaacatggtgaaatcctgtctctactaaaaatataaaaattagctgcacgtggtggcgggcacctgcaatcccagctgctcaggaggctgaggcaggagaatcgcttgaacctaggaggtgaaggttgcagtgagccaagattctgccactgcactccagcctggacgacagagcaagactctgtctc

SEQ ID NO: 360686 - DNA, 573 bp, Homo sapiens
cacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360687 - DNA, 362 bp, Homo sapiens
tcccctccctgtgcagttttttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccgtgtgtggtgaggacggccagttcacctactgctggcacgatgacatcatgcaaggtacggcctggcgcctacc

SEQ ID NO: 360688 - DNA, 6034 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360689 - DNA, 6163 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagtctgaggatagccagaccccccaaacaaggcttgaataactctccacccgtgaaagaattcaaggagagctctgcagccgaggccttccggtgccgcagcatcagtgtgtctgaacatgtggtccgcagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagtggcctctttctcctccctgtaccagtccagctgccaaggacagctgcacaggagcgtttcctgggcagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360690 - DNA, 5965 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360691 - DNA, 4788 bp, Homo sapiens
ggctcggccatccaggcagtgctgccgggactgagctcggtgctccctgcaggatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360692 - DNA, 4498 bp, Homo sapiens
ggaacagcagctgccatcacagccactgtggccccttgagaggatctggggggtgtcctgggccacgtgggtcagggtggcccctggagaggatctgggggtgtctcaacccatgaggcccggagcggcctcagagggctgggggcgtctgtccccatgcggcccagagcggcctgagagggctgagggcgtctccatgcggtgggtgtgtagcgaggcctctggtgccaagtccatgtggggagtggaagtcagcctgtgtcatcgtgcctggtactgcagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360693 - DNA, 4851 bp, Homo sapiens
ttcacccaacacaggagcctcttaaaaattctgtgtgagttcgtttcagccagtcttgcatggggacattgtcttccgtttcagtcctgacgtccaccctgtgcacctgcgtgatcgccagccctgcctggtccctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagcacgcacacacacgcatattcacgcatgcacaggcacacacgtgcacatgcccacgcgtgcacacagccacacacaccctcacgcacacacgcacagcaccatgtgggaggggttctcggctgtgacagtgaagggcagggcctcacctcggctgctccttgtgagttgtgggccccgtgtctgtgcccggccgccctgcggtgctcaccagccttctgaacgaggagctggacaggatccctggaaggggccccggggtctctgagtcgcgctcagcgggtgcttgtgctctctgcccagctgtgctgaagtcccgagggacatgtccgctgcttgcgggtcggttcctgaggaattggaagtgtcacgagatgtggccctcgttgggctggcgctcattggcctcccttgtgcctgtgcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360694 - DNA, 3369 bp, Homo sapiens
gaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagaggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360695 - DNA, 2507 bp, Homo sapiens
ccccaaaggttttaaacccccccctccgcgggttggtagcgaggctgggtggccggagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360696 - DNA, 5845 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtccccctcctgcactggccttggacggtattgcctgtcagtgaaataaataaagtcctgaccccagtgcacagacatagaggcacagattgcaaaaaaca

SEQ ID NO: 360697 - DNA, 1394 bp, Homo sapiens
tagaggactcccgtcctccccgttggcggagcgctgatgtggcggagccgggcaatccacttgagaggggtagatatcggtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360698 - DNA, 1641 bp, Homo sapiens
caggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccaacatccagcagccccgtctgtgtcctcccagactccgccgtggtcatggaggagggaagtccgggcgaggttcctgtgctggtggagcccccagggttggaggacgttgaggcagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360699 - DNA, 1070 bp, Homo sapiens
cacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360700 - DNA, 3527 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagcatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360701 - DNA, 1692 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcgggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagtaagaaaagaattgagatcctgttctgataatggtcctaagttcagctccgcagtgaataaagttgaaaccaccaaaaaaatagaggttgggctgggcacaatggctcacgcctgtaatctcagcactttgggaggccgaggcaggcggatcacgaggtcaggagttcgagaccagcctggccaacatggtgaaaccctgtctctactaaaaatacaaaaattagccgggcatggtggtgggagcctgtaatcccagctactcaggaggctgaggcaggagaattgcttgaaaccggaaggcagaggttgcagtgagcggagatcgtgccactgcactccagcctgggtgaaagagcaaaactccatctcaa

SEQ ID NO: 360702 - DNA, 1522 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagt

SEQ ID NO: 360703 - DNA, 594 bp, Homo sapiens
tctgggggtgtctcaacccatgaggcccggagcggcctcagagggctgggggcgtctgtccccatgcggcccagagcggcctgagagggctgagggcgtctccatgcggtgggtgtgtagcgaggcctctggtgccaagtccatgtggggagtggaagtcagcctgtgtcatcgtgcctggtactgcagaccttggacagcccggagctcaggaccatcgtccatgacctgttgaccacggtggaggagctgtgtgaccagaacgagttccacgggtctcaggagagatactttgaactggtggagagatgtgcggaccagaggcctgtgagaccccctcctgggtggggcctttgggctttggctggtggggaggggccgggtgctgggtgaagtgcagctttctgagcctcagaagccaagggccaggtgggcgcctgctttccaggtttctgcactcggcagggaaggctggcaggcacagcacgtgtttggtaacaagctcggggctagcccacccatcagtttcctcccacctgtgtggagcaagcttccatccggctctgtagagtcctgtggctcccaggcggccgc

SEQ ID NO: 360704 - DNA, 699 bp, Homo sapiens
gaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagaggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccagtgagtccccgccctgcctgcgcatgcacccgagaggttcgggctgtgtaacctgtgcgggcttctctggtgccctctctcaggactccttggggaacctgggtgtctcgccttctgctg

SEQ ID NO: 360705 - DNA, 6055 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcgggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360706 - DNA, 4060 bp, Homo sapiens
caaaattcatccataagatgttggatggtagaacagtttcctgtctgctgactggattgttccacccagcgccatgtgtccaggcccgtccaggctgtggcagctgttggtgctcccctccttttcatggctgagtagtattccatcatctggaaggagcacattttgtctgtccgttcctccattggtggacatttggcctgtgtccgccttgcagctgcgtgaagtaagctagagaaaagcaaatgctgttaagatgctaggcatggtgactcacgcctgtaatcctggcagtttgggaggccgaggcgggcagatcatgaggccaggagttcgagaccagcctgaccaacatggtgaaaccccgtctctactaaaaatacaaaaattagctggatgcggtggtgcgcacctgtaatcccagctactcgggaggctgagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360707 - DNA, 2491 bp, Homo sapiens
  misc_feature (38)..(38): n is a, c, g, or t
gcgggacagcacctaggctaggtacgaggctgggtggnggagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360708 - DNA, 2167 bp, Homo sapiens
caggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccaacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360709 - DNA, 5597 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagccctcctgcactggccttggacggtattgcctgtcagtgaaataaataaagtcctgaccccagtgcacagacatagaggcacagattgcaaaaaaca

SEQ ID NO: 360710 - DNA, 942 bp, Homo sapiens
agcatgaagtgctcattgagctctgtgccaggtgctgctctgagtgctggggaccccggtgcgagtgacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaca

SEQ ID NO: 360711 - DNA, 3640 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgtttccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcaacagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcccctcctgcactggccttggacggtattgcctgtcagtgaaataaataaagtcctgaccccagtgcacagacatagaggcacagattgcaaaaaaca

SEQ ID NO: 360712 - DNA, 1918 bp, Homo sapiens
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcgggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccgctctctgctgggggtggggaacgcccaggagtctggtgatgtcggcgtctcccagcctcgggttgggccctgagtgtacggcatacacacttctgctgccgcc

SEQ ID NO: 360713 - DNA, 571 bp, Homo sapiens
tccctcctgaacctgatctcctatagagcgcagtccatccacccggccaaggacggctggattcagaacctgcaggcgctgatggagagattcttcaggtagggggtcctctgtagccttgcctggcacctggagcctggccctgtctctgtctggggcccacccgggctgggtctcaggatgcccgatgagcagggccctcccctctgcctctggagagccctggctctgggtgagcaggtgctagcttgctttccagtccagcaggacaggtcctctcatgacgccactgggctccctcttttcgggggtcgtctggagagatgctccctgggaagcagagctctgtgccctgtgtgcctggccgcgggaggacccagagtcgggctggcctgcgccaggcagacgggctggtgtggggctgtggccgggcactccccacccgccccagcaggctgccgtcccgcaggagcgagtcccgaggcgccgtgcgcatcaaggtgctggacgtgctgtcctttgtgctgctcatcaacaggcagttctatgaggtgcgtgtccaggcggccgc

SEQ ID NO: 360714 - DNA, 858 bp, Homo sapiens
gtcactgggtgcctgccagtagaaaatatttccaagtgtttaggtcagtgtgactccccttatgatcctgaaaattggagaaaatgcagttaacaccaatggggtaaatgccttctgatgtggtcatgagaactggtggtgggcatgagacctacagagaggttatctaacattgtgcttttcccccagtaggtgctttatagcttttagtggcagtgttttgcaaaatgagttatgacaattccataggatttttgtattgttttgtttttttgcttgtaataaggctagatcaatttttaaagacttatgttttcagcccctatagaaatgtgaatggttaaaatcttttaggacatatataccatttgtttttcatatactcagttttagtttattttaaattttaaaaagcataaggaaccagcattctaatcacacacacacacaaaaagcatacctatttaattgagtctgaacagtacttctcaggagtttgtcaaatgttgaggctgctgttatataaggcagtaacaacagattgtttgtacttgccctctccaaaacgggttgcgcaaactatggctattttgtaagaaaaaaaaaaaacaaaaaaaaacaaaaacaaaaaaaccttttatcagaatacagccctgggcatttctgggatgtttacacgtgtaactgctttcttcctccagcagcacagtagtaacatgtggcctgcacagcccatacttactgactacctggccctttacagaaaaagttggctgattacttcccttcaataatgacattatgcctttacataaaaataatgaggctccctatttcctttgagtgtgattctggcta

SEQ ID NO: 360715 - DNA, 1109 bp, Homo sapiens
cagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgaggacgatgacatgaatgaggacacagtagagaggattgttcgctgcatcatccagaatgaagccaatgctgaggccttgaaggagatgctgggggacagtgaaggagaagggacagtgcagctgtcagtgtggatgccacctccagcctgcaggacggagccccctcccatcatcacacagtgcacctgggctctgcagccccttgcatccattgcagccgcagcaagaggcctccacttgtccgtcagggacgctccaaggaaggaaaaagccgcccccggacaggggagaccactgtgttctctgtgggcaggtggggcaggtgctccaggga

SEQ ID NO: 360716 - DNA, 2131 bp, Homo sapiens
cagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtcagtgtggatgccacctccagcctgcaggacggagccccctcccatcatcacacagtgcacctgggctctgcagccccttgcatccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccaggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccatta

SEQ ID NO: 360717 - DNA, 1456 bp, Homo sapiens
cagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtcagagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccatta

SEQ ID NO: 360718 - DNA, 2530 bp, Homo sapiens
cagctctcccggtatctggggctttgagcgtcccgggttgggcagggaactggcagcatagctcctaggatgcgagggccatttgtctccggccgggggtcagatcctcgggaagccgagccatcccatccagccgcttgccccaaaccgggcgcaggccgtggtcacttctctaggaagctccgaagatcccgccactccgtccctcaaaggtgcggaaagccggcttcccccagccctcggagaagattcctgactctccgctcggtcggggcatctgagggcaggagctgcgccaggcgtaccggatagaccagtggacaacacccacgccggaccgcctgtcccctacccggacccagactcggcgccgcacattgccccgggggggcccggcgcagtcacgcgcgcgcagagctcacgctctccgccccgcacacctgcgctccgccccctggtcctgggcccgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccgctgcagccccctaaacccaggaggcgccctggcccgcgctcgccccccagggcctcatgtcggaaccacagcctgacctggaaccgccccaacatgggctatatatgctcttcctgcttgtgctggtcttcttcctcatgggcctggtaggcttcatgatctgccacgtgctcaagaagaagggctaccgctgccgcacgtcgaggggctctgagcctgacgatgcccagcttcagccccctgaggacgatgacatgaatgaggacacagtagagaggattgttcgctgcatcatccagaatgaagccaatgctgaggccttgaaggagatgctgggggacagtgaaggagaagggacagtgcagctgtcagtgtggatgccacctccagcctgcaggacggagccccctcccatcatcacacagtgcacctgggctctgcagccccttgcatccattgcagccgcagcaagaggcctccacttgtccgtcagggacgctccaaggaaggaaaaagccgcccccggacaggggagaccactgtgttctctgtgggcaggttccgggtgacacacattgagaagcgctatggactgcacgaacaccgtgatggctcccccacagacaggagctggggctctggtgggggacaggacccaggggtggtcaggggtctgggggagggcagcccaaggcagggatgcctgccatggagaggctgccccctgagaggccacagccccaggtcctagccagccccccagtacagaatggaggactcagggacagcagcctaacccctcgtgcacttgaagggaaccccagagcttctgcagagccaacactgagggccggagggaggggcccaagcccagggctgcccactcaagaggcaaatgggcagccaagcaaaccagacacttctgatcaccaggtgtctctaccacagggagcagggagtatgtgagtctccttcattgtgctgatggactaccagctggcagggccagggggtgggtgggcgtgaaagccctcccctccactggacagcactgccccccagctgagggaccagctctacttccacctggagttgcacagtctcaggctgggggcctcaggagaggtcacagcccctcagtctcttctccttcccctgcctgcaacaggctgcctgccccgccttccccaacacctcgctccatatgatagagcgtggcagctgggagcaggcccctgcccgtggtgggcccctaaagcaatagcaccgtaggccccctgccctcttagcacaagaggcccaggccctggcctggccttcgtgccctttattcattgtcaataaatccgctcagaccattaaaaaaaaaaaaaaaaaaaaaaaaaaaaaaaaaaaaaagggggggcgcgccaagaaagtttccccgcagagggggcccccaggtttaaaggcgcttccccgaggttttgttgtgtgcacaagggtggccccctaatggggcgaccgggatattaagaagcctgaggacagctggcacgagacgttataaaccggtctcgtcgatcgctgaggaacacacgctgcgcctactcgggaggacacctgctggggaagaggagacacccctttaccaccgcggggggggtgcgcaccatcatgtggcgaccacaaatccttccctcagcgagagaattttaaaagaggcccaagagggcgacactattcacactctctccagacgcgtctaaaacaacgggcgc

SEQ ID NO: 360719 - DNA, 722 bp, Homo sapiens
cgcgacgggtgaaggcatttgggaagccagggcggctgcggaggcgatctccctgacccagggccggagttgcccggagcctgccaccgctctcagccagcccgcatccttctctgttcttccctccccccgcctgccacggcgcgggtatccgcagccacagcccggggccggtgaggcggcgaagggggaggggaggaatcaagggatgagcgccggaagggcgtcgggggccctgagccgcactaggacgcccctggagccggaaccccagcagaagccggaaccagaaccaaatcaccggggtcggccaggtggtcagggtgggagaaaccaaaaagggagaggggtgcgggagtactgagaggaaggggctgcagaggcctggctcaggccggcgtggaggaggtgcgggcgctgactcaggcaggatttctgctcccgccgcctaagaatgccgtcccatctcgtgctgcagtgtccttgggagggacagaagcgcgaacaagctggaaaggggaacgctcggggcgtcggggaagcgggaccagggtcgtggtagagagcttgcgttgccgctgacctcttgccgaaaggcgaaacagcactcctggcccggacagctccctggttgggtagggggtggggccggacctcagccggacgtcttagacgtgcttgtttcagatcctgaggacggcattcctacccctcccccattc

SEQ ID NO: 360720 - DNA, 1949 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgaaagaggt

SEQ ID NO: 360721 - DNA, 1919 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtcagtaccgcacccttcccatttgctgcctgtaggtccaccccgcgcgtgcggtccccaagtggccatgccaccctgcacgccctccccgcgtcagtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 360722 - DNA, 1527 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 360723 - DNA, 1897 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggtaaaaaaaaaaaaaaaaaaaaaaaaaaaaaaaaaaaaaaaaaaaaaaaaaaaaacaaaaaaaaacaaaacacaaaaagggggggggcgcaaaaaaaaaccctgggggggggcccgagtattaactacgcaccaattgtttattgataaagaggtggtgctctaaaaatagagggtataatataaacgaagagagggggcgtgcagtaaaacacgcgtggtggagagacaacgagggcaggtggcactatgtgcgagaaggaccttttggtgggtggggacattggggaaccacctcagaaaataaggtcggggaaataaatcgagtatttgtggtaacgaatatgttcgggaatgccgactatatcagaatc

SEQ ID NO: 360724 - DNA, 1827 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggtcacagatgggccgtgcacgggcagatgggccccaaaaaatcttggcgaaggtcggtaaagtgctaagctgttgtctgcactctttcatcataaagtcacttttttccactgaaagaggt

SEQ ID NO: 360725 - DNA, 2251 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtcagtaccgcacccttcccatttgctgcctgtaggtccaccccgcgcgtgcggtccccaagtggccatgccaccctgcacgccctccccgcgtcagtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccctcagcacactgtgaggcccgctttggtgtgcacctgccactcaatgctctgggcatcatagccaaccgtggccagcattttcacggtcagaacatgaccattttctacaagaaccaactcggcctctatccctactttggacccaggggcacagctcacaatgggggcatcccccaggctttgccccttgaccgccacctggcactggctgcctaccagatccaccacagcctgagacctggctttgctggcccagcagtgctggattgggaggagtggtgtccactctgggctgggaactggggccgccgccgagcttatcaggcagcctcttgggcttgggcacagcaggtattccctgacctggaccctcaggagcagctctacaaggcctatactggctttgagcaggcggcccgtgcactgatggaggatacgctgcgggtggcccaggcactacggccccatggactctggggcttctatcactacccagcctgtggcaatggctggcatagtatggcttccaactataccggccgctgccatgcagccacccttgcccgcaacactcaactgcattggctctgggccgcctccagtgccctcttccccagcatctacctcccacccaggctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgaaagaggt

SEQ ID NO: 360726 - DNA, 1382 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 360727 - DNA, 1774 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgtcagtaccgcacccttcccatttgctgcctgtaggtccaccccgcgcgtgcggtccccaagtggccatgccaccctgcacgccctccccgcgtcagtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 360728 - DNA, 1938 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacattggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 360729 - DNA, 1183 bp, Homo sapiens
agccagggtagagactgagtcggcgcctggcgggtgttgtgacgcgcaaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgctgccacctgcccaccaccaggcctttgtccgacatcgcctggaggaggccttccgtgtggcccttgttgggcaccgacatcccctgcctgtcctggcctatgtccgcctcacacaccggagatctgggaggttcctgtcccaggatgaccttgtgcagtccattggtgtgagtgcagcactaggggcagccggcgtggtgctctggggggacctgagcctctccagctctgaggaggagtgctggcatctccatgactacctggtggacaccttgggcccctatgtgatcaatgtgaccagggcagcgatggcctgcagtcaccagcggtgccatggccacgggcgctgtgcccggcgagatccaggacagatggaagcctttctacacctgtggccagacggcagccttggagattggaagtccttcagctgccactgttactggggctgggctggccccacctgccaggagcccaggcctgggcctaaagaagcagtataaagccagggcccctgccactgcctcttcttttccctgctgccacttttccagtcctggaactactctgtcccactcttgctctattcagtttacagtcaaccctcccaagcacacaccccgcttcccttggaatccctgaggggtagaaggggccagaaaaaacgcttataaaaccagaggccctctgagatcatgtgagtcctccatggcaaggaagcagttccagggagagtcaggttccagctagttagggctgccagcctagggctttgtgcctacacctcactaagcccatggagaggtcacagatgggccgtgcacgggcagatgggccccaaaaaatcttggcgaaggtcggtaaagtgctaagctgttgtctgcactctttcatcataaagtcacttttttccactgaaagaggt

SEQ ID NO: 360730 - DNA, 411 bp, Homo sapiens
tgtggtttatatttctcaagttcaaatgttcaatgacatataagacaaattcatcacataagaaataggcaaggttggcatagcagtagtatctctaaaattaaatacactttagttctttaaaaatgtgatcacaatgattctcaaccagggacagtttttacccttgggattttttttttttttttttttttgagacggagtctcgctctcttgcccaggctagagtgcagtgacgcgatcacggctcattgcaagctccgcctcctgggttcatgccattctcctgccccagcctcctgagtagctgggactacaggtgcccgccaccacgcccggctaatttttttttgtatttttagtagagacggggattcaccgtgttagccaggatgatctcgatctcttgac

SEQ ID NO: 360731 - DNA, 840 bp, Homo sapiens
ccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtaagatgattaattgcactgcaggttttttgtttctgtatttttttccctcctttttttgggtttacttacacattaatgaggtatttaggaaagacaaatggaatctgataaaaggtaacgttatattgtttgtcgaaacaacattttaaggatttcttgaagttatatggctctgtaggcatgtttcactttaagatgtgtttctgagtcatattaggagaacgactgggattatctatggaagattaactatgaaacatatgggaaatatactttataactgtatattacttataaacccatgaatagttacatgacttttggtatgtggtgagagatgttaagtgaaaggtgttgtaaatgaagtcgttttataagactgttgttactgtaagaattgagacttattttatcacttcccattaagcttctacagtgttagagaggcataacccaatgttgactgaaggtgctatgttttctttttaatttattttttattttgcagtgagcccatatcgtgccactgcactccagcctgggcgacagagcaagactctgtctca

SEQ ID NO: 360732 - DNA, 5803 bp, Homo sapiens
  misc_feature (796)..(796): n is a, c, g, or t
caacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgcggccgggaggagccggagcgcggccgggccgggcggtgggggcgccggcctgccccgcgcgccccagggagcggcaggaatgtgacaatcgcgcgcccgcgcaccgnagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360733 - DNA, 5179 bp, Homo sapiens
ccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360734 - DNA, 5747 bp, Homo sapiens
  misc_feature (796)..(796): n is a, c, g, or t
caacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgcggccgggaggagccggagcgcggccgggccgggcggtgggggcgccggcctgccccgcgcgccccagggagcggcaggaatgtgacaatcgcgcgcccgcgcaccgnagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360735 - DNA, 5065 bp, Homo sapiens
  misc_feature (1062)..(1062): n is a, c, g, or t
  misc_feature (1459)..(1459): n is a, c, g, or t
ttttactaagagggtttctaaaatgaaaagtggcatatacaagaatactagttattcttacacagaattatagttttagaactcattaggctgaatatcattgttttctaagttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctcctttgtttaaactttgcgaaaaaaaaaaaaggaataccacaatatctaaaaaaaaatgaatggataggattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttantgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttntgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360736 - DNA, 1900 bp, Homo sapiens
  misc_feature (28)..(28): n is a, c, g, or t
tgcagagctgattctagaggatccctgncttgatgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360737 - DNA, 6120 bp, Homo sapiens
  misc_feature (796)..(796): n is a, c, g, or t
caacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgcggccgggaggagccggagcgcggccgggccgggcggtgggggcgccggcctgccccgcgcgccccagggagcggcaggaatgtgacaatcgcgcgcccgcgcaccgnagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaccagacaccagaaaacaggaaaacaacaaccacaacacccagaaacaacaaaaaaaaaaacaggcgcaaagccaacgaacgaagacacagcacacaagaacagcaacatacaccaaagggagggacgagcacactaagcatacccgggggaggaaacaaaaactcgacccagttgagaaaggccgccccaagcgaagcgttataaaagacagcccgcgccaaaccgaggagtgacacgcagctctgtgacaaccccatgtgggagcccaccacacagagccgcgaacatggtgcgcaccag

SEQ ID NO: 360738 - DNA, 1459 bp, Homo sapiens
tgaagcggccagcaattggagtggctccagtggcagcagcaaacttcagcacagcctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360739 - DNA, 5076 bp, Homo sapiens
aatgtgaaagatgattacagtggccagaggactgccaaggctccttctcaagctgcttgagtcaatgaggatgtagaaactgagatccagtgagatgaagtgattttcccaaagatacatagatgaagttgaagcttagctctttaacccaggtctgctggcgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360740 - DNA, 4978 bp, Homo sapiens
aatgtgaaagatgattacagtggccagaggactgccaaggctccttctcaagctgcttgagtcaatgagggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360741 - DNA, 6510 bp, Homo sapiens
  misc_feature (796)..(796): n is a, c, g, or t
  misc_feature (2507)..(2507): n is a, c, g, or t
  misc_feature (2904)..(2904): n is a, c, g, or t
caacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgcggccgggaggagccggagcgcggccgggccgggcggtgggggcgccggcctgccccgcgcgccccagggagcggcaggaatgtgacaatcgcgcgcccgcgcaccgnagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttantgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttntgaaaagccttgtgtggctttggttcaggagagaatgatgataaatagaattttacttactatattgtgcttcctgtttttcagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgtta

SEQ ID NO: 360742 - DNA, 4512 bp, Homo sapiens
  misc_feature (796)..(796): n is a, c, g, or t
caacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgcggccgggaggagccggagcgcggccgggccgggcggtgggggcgccggcctgccccgcgcgccccagggagcggcaggaatgtgacaatcgcgcgcccgcgcaccgnagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttataaaaggaaaagtgatggcatctataacataaatctcaagaggacctgggagaagcttctgctg

SEQ ID NO: 360743 - DNA, 935 bp, Homo sapiens
gattagagacatgcccagggttgttgaatggccaatgattactatcccacagggtgagtaatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgctctccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtccttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagttctgctcttaactctgagaccttggacaatgacttctttctgtgcctcagttccctaaactttaaaaaaagagtgtgg

SEQ ID NO: 360744 - DNA, 249 bp, Homo sapiens
gcccaaaatctcgctgcccacctgggtgcagacagcgtgagggctgcccactccttgaatggtgggccccggactccccgccaggacttctccccagctccctccaagggtcacagtgcctctccttccccagcagtgggttcggccctgagcctgcttagtcatctctcccacctcccatttgacagcagctgcagccacagtgggggcagtgtgggtctcccatctgtccccagttgcaagagatac

SEQ ID NO: 360745 - DNA, 363 bp, Homo sapiens
ttcttctttgacccaatggttgaatatattgtttagtttccatgtatttgtgaatttttccagttttcttttattgatttctagtttcatttctttgtagtcaaaaaagataattgaaattatttcagtcttcttaaatttgtcagaacttgttttgtgaccttgcatgtaatctatcttggagaatctttcatgtgcagttgagaggaatttttattctgctgccgttaggtagaaggttccgtacatgtctgttagctccatttggcctatagtgttattcaaaaccactgtttctttatttctctaatgtctggatgaactattattgaaagtggggtattgaagtctcctaatacattc

SEQ ID NO: 360746 - DNA, 966 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagatgctggctccaacccaggcaaagggttacaaccacctataaccagtccccagccagcttcctcagctccatattaccatcacagcctgattacaatagcagtaaaatcccttccgctatggattccaaattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360747 - DNA, 930 bp, Homo sapiens
  misc_feature (878)..(878): n is a, c, g, or t
  misc_feature (883)..(883): n is a, c, g, or t
  misc_feature (887)..(887): n is a, c, g, or t
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcaggtggcaacctataaatggaagcatcccaatggaatgtgtagccataccagaatcctgatctgaatacaggtcaaagagttggtccgatggaagagtgatggggcctttctaaggatacggacttgaaganggtcngtgnggcccaaagagcggggtaaccaagaaggggcaaacgcgcatca

SEQ ID NO: 360748 - DNA, 868 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaaggagtggactggcagctcctgatgtgtcatggtatcctaactgggagaccgtcacctcgatgattggcccaatgatcgtgtcgggaaggctcctcctcatcttggaagtgtcgagtcgagcgggttgctgtgtgccaataagggaaccctcctgggtg

SEQ ID NO: 360749 - DNA, 413 bp, Homo sapiens
ttctttttaaaaatcttttctttttcctttttaaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaagtgggcaagatgtctattttgtacaaaaggccaattaaactataaaatctaattttaataaggaagttctagctcacagatctaggtccatatatcaacaaggaataagattatctaaaaagaaggaatatttgggccctattccatttctctctgcatgaaatcacctcttggtttacagtagtaaaagaatgaagcaaat

SEQ ID NO: 360750 - DNA, 627 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaagtgggcaagatgtctattttgtacaaaaggccaattaaactataaaatctaattttaataaggaagttctagctcacagatctaggtccatatatcaacaaggaataagattatctaaaaagaaggaatatttgggccctattccatttctctctgcatgaaatcacctcttggtttacagtagtaaaagaatgaagcaaat

SEQ ID NO: 360751 - DNA, 1879 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360752 - DNA, 2205 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaaggtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360753 - DNA, 2283 bp, Homo sapiens
  misc_feature (2190)..(2190): n is a, c, g, or t
  misc_feature (2194)..(2195): n is a, c, g, or t
  misc_feature (2197)..(2197): n is a, c, g, or t
  misc_feature (2214)..(2214): n is a, c, g, or t
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacaccncttnnangctggaaacgttacggnggctcaaacggtcaccgcctcggggaacaccggagaaaatcgggtcccggtttccgaaaatctttgcaa

SEQ ID NO: 360754 - DNA, 1517 bp, Homo sapiens
ggcttctgctagagtggtagtatgttagtgcactgtactttaagggcttaaaagctgaatatatagaacttaccaggctgttcaaatacagccaaaataggaatgttcctttcaactgtaactacttaattctgcttcattcaagctaacaatgcatgtaaacattcttacttgttttaatttcaagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360755 - DNA, 1260 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagatgctggctccaacccaggcaaagggttacaaccacagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360756 - DNA, 1417 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagaagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360757 - DNA, 1854 bp, Homo sapiens
  misc_feature (1766)..(1766): n is a, c, g, or t
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctccttgcagtcgcgcatgtcctgagttgtgttgctgcgagtnttgtgcaccactgtcatcctgagctttaaacacagcagctgcattctgtggtcctagcaatctgcgagccatcttctctgcatatgtt

SEQ ID NO: 360758 - DNA, 937 bp, Homo sapiens
ggggggatgtttaattcaagaaaaccaatagctatttggcaataaatagatacagctttggaattttcaaatgtttttttcttcctagtctgactgttggtcagagacatccacttcacagaaataattcctgtactttcatttcttaaaaatttttatttcagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360759 - DNA, 2338 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360760 - DNA, 1986 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360761 - DNA, 1966 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacaaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360762 - DNA, 1857 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360763 - DNA, 1717 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcgtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360764 - DNA, 1516 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 360765 - DNA, 2045 bp, Homo sapiens
gatggacaggcaagcacatcagatgtcactgtttggcagctgataaaagtcagtggtgctataatactaagacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggcaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataaggtaggatatgtatttctagacttactatagtttatttgggtgaatccagttatactttttaacatgcattataaatggcatgcatttatctcaatttgtctagtttttaaaacactaaagaataatataataaaatatatattagataaaaatgtaagaaaacttcagtaagccagattccactaatcagaaatgtaaggcataaagtagactaggatttatctttttatcaacgatgatgaaagatggcccaaggaaataaatgacataaacaagattaaagggggatgttttcttttcttttctttctttacaaaaagcttcagcctttattaaacaaaggaggaggtaggagacagataacggaacaggtcaggacccctccattcccctatacatacgcataaatacaaacacagacacacccgagtgaatgacagggaccatcaggggacagattgaagagcagagggagacagc

SEQ ID NO: 360766 - DNA, 404 bp, Homo sapiens
tgcctcacagtgtcatcagagccaggggaggacaggagaagtgagcacaccgttgctgggaggtgcatcctgccaagcccagcccgtggctctgatgcccacgggctccagcatgcagtccagagtgcagaggctgtgtgcagcaggggtgtgacaggcccctgggtgggctgacgggaggccccacccacccatacacacctggggtgctcgggggtggggggttgctggtagggtcctggcctgaagcctgcgaggcctggatgtcaggccaggctctgggggtgggccggggatgcctctgggcacctgctgccgcctccatacactactgactgtctcatgtggcctctggccattgccctgctgtctctgttcccggaaagtggtcccaattcagatcc

SEQ ID NO: 360767 - DNA, 510 bp, Homo sapiens
tgcagcagaattcattccatgtcccctctggatattagactgataatttggatcaggtctcagcatgggccattgaggaacactacagccctgctgagagataaaaaggattatccactcaaggagttcacacctccgggccgacatggagaacgtgcctagaagcagacttggagggtgctcagtggtgggttgtggaatgtaagcctgaagaagcagagtttaattctacgggggtgctttcataatttagtaccctgacagggctcctggtgttggtccttagacactcctgggatggctccctggaaacatggaggaaaccttggtcgcatgacatgatacggagatgttggagctgcctggacacagttacagagggaggcattaaaaggcttcgagagaaccctaaaccttgaatcagccttatagtcctggctcctagaagagtgtttctcaaagtgtactccacggaccacctggataagaagcacgtgaggcttttaatta

SEQ ID NO: 360768 - DNA, 467 bp, Homo sapiens
agaaaatgactcttcctgtctcaaaatgcagtccttcattctgattgatgaattggaagcacatggctggtgtaaagaataagaaactaattataagccaggaaacagcaggagaagaaagcagagaagcaacgcttaccctgaagaattaatttccgtttagaaaatatcacagctgatgtgtcaaaggccccggtatgcaggaatgagattaaacaaatgtggtcatgaggaagaggtttctgaataatgatagagaagcttgagtctacaagaaatccagagtccagaatactgcaggggagcagtgctgggttcatgtttatctggtctcttgtctattggatcctctttcttccagaaccctaaaccttgaatcagccttatagtcctggctcctagaagagtgtttctcaaagtgtactccacggaccacctggataagaagcacgtgaggcttttaatta

SEQ ID NO: 360769 - DNA, 2073 bp, Homo sapiens
cgcgagacgggtgcgcttacgccacggcgtctgctggcggccgcggagacgcagagtcttgagcagcgcggcaggtgagtagctgtgcgaattcggttctctagggaactccttcttcgcctgctggccttacctgggctccccgcttctctggaggggaggcggtgcgggaactcccgtaggcgtgagctggagcgcgcgcccgctgctctctccaggtcccgccgcgccagttcgcctccgcaaagcccgtccctctcttccgcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaaccccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagaactgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaactttgtgtttctaaa

SEQ ID NO: 360770 - DNA, 1256 bp, Homo sapiens
agagcatgccgctgcactccagcctgggagactgcatcaacatacccagctaattttttttgttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagaactgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaactttgtgtttctaaa

SEQ ID NO: 360771 - DNA, 757 bp, Homo sapiens
gatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagaactgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggctgaggcgggcagatcacttgagg

SEQ ID NO: 360772 - DNA, 1879 bp, Homo sapiens
cgcgagacgggtgcgcttacgccacggcgtctgctggcggccgcggagacgcagagtcttgagcagcgcggcaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccgcggtgcgcaggagggaggccttcgaggccataaaggcggccgccacttccaagttccccccgcatagattcattgcggaccagctcgaccatctcaatgtcaccaagaaatggtcctaatcctgagtcgtcacccttggattttatggatcacggagctgaccatctttacctggtcctggaactgaaaaactgtagcttgtgtgaaaatgagcctttggaccagtctttattaaaacaaacaaacatgagtagtctgcatatcgaatatctagagctctaaaccccccaatacttaaaagtctaattgctgtcctgtggtttcattagtctgataggaagatagggatttcctcagtcacagatgatattttgaaggaaagctgcaataaagccacaatgatttgaggtctttgcttaagtatgagatacttgatgggggctttatcatgcaacattagtttgcttaccttaagaattgcccaaaaatgaaagaaaatatgagcttttcagttaaacatactcctaaaaacattttccgggattttactactaaaattggacatttaagcgaagtaaaagaggccgggtgcggtggctcacgcctgtaatcccaacactttaggagtccaaggcgggcggatcacttgaggtcaggagttcaagaccagcttggccaaggtgataaaacccgtctctactaatacaaaaaaaattagctgggtatgttggtgcaggcttgcaatcccagctacttgggacgctgaggtgggaggatcgcctgaacctcagaggcagaggttgcaatgaagcggaggttgcagtgagccgagagcatgccgctgcactccagcctgggagactgcatctcaaaaaagaaaaataaacgaagtaaaagatatttatcagaactgttacaggaaggtgtattttttagctattttggcagggtgctgtggtgcttgcatgtagtcccagctattcaggaatattgcttgagtccagcttgggcaacatagcgagaccctatctaaaataacaataatatatggccaggcgggatggctcacgcctgtaatcccagcactttgggaggcttaggcagaaggatcacctgagatcaggagttccagaccagcctggccaacatggcgaaaccccatctctactaaaaatacaaaaattagccgggcgtggtggcttacgcctgtaatcccagcactttgggaggccaaggtgggcggatcacaaggtcaggagttcgagaccagcctggccaatatggtgaaaccccatctctactaaaaatataaaaatcagcaaaaaaaatttagccaggcttggtcatgcatgcctgtaatcctagctactgggaaggctgaggaaggagaattgcttgaacccaggtggtggaggttgcagtgagctgagatcgtgccactgctctccagcctgcatgacgggagtgagacaccatctcaaaaaatacatataataatataaataaaaatatcttttttgaaaataatttaatataccatgtaatttaccagttgaagatgttcgctttcagaatataataaaaatagtcaaaaactttgtgtttctaaa

SEQ ID NO: 360773 - DNA, 582 bp, Homo sapiens
tattagactgagattttatttatatgagccaagaaaccaaaataaaacacccatatttctaatttgagagatcaagcagtgctaaaaatcacataactgtaggcagttctttaatcaatcagtccaaactttcactcttctgtggtaagaggaagaattcttttgagaccatttttagttctaatttccttttttggtatattaagaagaagataaaagaataatatatatctttcagctcctaggcatgtagaatttatataaacttgagcaattctgtgatatgtttgccactaataaaatgaataatgtcatttgactgcttggagatcacttattaaaccataaatctattattttgcttttagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaa

SEQ ID NO: 360774 - DNA, 546 bp, Homo sapiens
gaacccaagattagttgacagtgttgattgtgagttgctttcttgagactcggagacttatgatcattcagtgaaaatatcaatgtgggtaatgtgctggacaccctgcagcagtacatcgaaggcagcatggaagaataggcagtattggatttgaaatcaggagacttggaattgaattctgcctcttccactaccagctgtgaaattggctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaa

SEQ ID NO: 360775 - DNA, 1762 bp, Homo sapiens
ctggctgcaaaagaggcgggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcgagacaggggctccctgtgtttcccaggctgcagtgcagtggccagtcacaaggttgatcatagcacattgtagcctggagctcctgggatcaagcaatcctcctgcctcatcctctggagtaactgggactgcaagtatacataccgtgcctgacgaaatatcacaatatttggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaa

SEQ ID NO: 360776 - DNA, 1255 bp, Homo sapiens
ctggctgcaaaagaggcgggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcgagacaggggctccctgtgtttcccaggctgcagtgcagtggccagtcacaaggttgatcatagcacattgtagcctggagctcctgggatcaagcaatcctcctgcctcatcctctggagtaactgggactgcaagtatacataccgtgcctgacgaaatatcacaatatttggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttaggtaagattaaatttaaaaaat

SEQ ID NO: 360777 - DNA, 534 bp, Homo sapiens
tgactgatcaaacagaccctgatgcacataagtaaatgttgtactttatgtcaagtcatctgttgtgtaaagtattcattcatttgtttccaattagtatattgagaatttggaaaaatgtgttaaacttgaagtactgaatctcagctataatctaatagggaagattgaaaagttggacaagctgttaaaattacgtgaactcaacttatcatataacaaaatcaggtgagttatataacaaaatctttaggcagcattgcagatagctttgttagagaggtagattaatgttatccacattactgaaagaatgatttgacagaaacagaagatatttttatctttattcatcaatcaaatgaatgtctgtctcttcacatatggtaggtaactgtctttatgttttggcattactgaagtacagaataacatctagcattatcaaagagatatatttttgagcaccaaattgtatcttaatttcatttctgacaggaagttttcccagatattgtctgtgatttattacct

SEQ ID NO: 360778 - DNA, 1589 bp, Homo sapiens
ctggctgcaaaagaggcgggaaacgcctccgcgtcccttccaacagtaccggagagggagaggggcgtggctgagactagccccgaccacgcgcgcgcggcccctcggcaaccggcacaacacaacaaaatggctgccgcgccgctgggcccctgaggaaagagcccgaacttctcccgctctacctcagcctgcgggactgctcggctcggcttctaggcggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggagctgattcacatgcaggagttagatatattacagaggccctcattaaaaaacttactaaacaggataatttggctttgataaaatctctgaacctttcactttctaaagacggtggcaagaaatttaagtatattgagaatttggaaaaatgtgttaaacttgaagtactgaatctcagctataatctaatagggaagattgaaaagttggacaagctgttaaaattacgtgaactcaacttatcatataacaaaatcagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcgctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattgctaaaacagaagaccatagaattaacacgagcatgtcagaagcaatatgagctggaacaggaattggccttttataaaattgatgctaaatttgagccactaaattattatccatcagagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaa

SEQ ID NO: 360779 - DNA, 824 bp, Homo sapiens
caaggtccactgatcattgcatcagttcaactaggaagtctgaagaatgccttcattcactaatgggaaaagcatgatgatttcaagctgacctacagaactttgtgcatcacctacaacattggcaagggtggctgagaagaaagctctccaatacttgaaattattttcaagtcacttgcaaataatctgcttactgggaggaaggaaacagcagaacgcttctgagaggtctggtgtgttccaatcacctatagagagaaaccacaggactaaaaataaatgaataaataaaaatgcccaggagttacagcaagtatgcatctttttgttaaattttctttcatgatgacacaaaacaaggactaaaaatgtttgcaagaaaccacaaggtgatctaatcagaacttagctaaaattacaaatctgacaatgaataaaattccctacttaataaataattctagaaataagctgataataatcgccaaagctcagtagtcattcaaaatgggcaacagtaataattcatatacctaggcctatctttaagttccattattcaagaaggaaactagtattctcactttatttttttctgaatgaatctagaaaatactttatagataagaatatgtccactcttgcaaaagataccagtggcaagcttcagtgtgaaagagacaagtatccatgtgtcagatgacagagttgccactgatttattagcaaattgaacttttgctttaagagaaaaaaacttctcaaaatctgtatctgataaattaacccagtccttcatgaacaccatttcaaaaagacac

SEQ ID NO: 360780 - DNA, 618 bp, Homo sapiens
acttcttcagggtgaaggtcatggcggaaaatgttgcatggattttgccctccctgctgtcagaacaacagggttctggaagagtagagaacaggccgtggaacttgcctgtctaaagacatggcggcagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360781 - DNA, 705 bp, Homo sapiens
tccggcgccggggctcacttcctggtgcgggaaggggcagagattggtgcagccccggaggaagaaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtgttgcaggtctaccccgagccccggagcgagagcgagtgcctgagcaacatccgcgagttcctgcgcggctgcggggcttccctgcggctggaggtgagcgcgggcggccacgggccgagggaggggccgggaagacggggttgggcccggggtgggtgcttcgctccagccggacctcctgcctcctccgcgcccggatccgaccctccccggctgctcgagagtccgggatgtgtggaacggggcgttgcgggtttgggtaatggccgggaggtggcggcgcgcgggccacccccagggcagggtggagtctgcgtgtggaaccccagacattgctctcgttccagtgaggaagagtggttctggtcgctggtggtgcaggtgacacacattttcaacaaccgtttatcaggggtgtgaaccgatttcttggcacctgcctcagcatgaactctg

SEQ ID NO: 360782 - DNA, 534 bp, Homo sapiens
  misc_feature (74)..(74): n is a, c, g, or t
tggaagatgagaacatttgcagtgacaccaatggcaaaaacatacgtttccaaaatccaaacctgaagcacttnggaaggaatggctaaacaatctttcaaagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaa

SEQ ID NO: 360783 - DNA, 5123 bp, Homo sapiens
tccggcgccggggctcacttcctggtgcgggaaggggcagagattggtgcagccccggaggaagaaaaaagggtgaggagaagcagcggctgagcgggttggcatctggggcagcgggctcgctccaggccgtcgggggccgctcgccagcgtcgcccgctgtgttgggagcgcgggccgtgggcgtcgctcggccttgtccgcggcgtccccgctgccggccacggcgctcagcgcttgtgctctgtgttgcaggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360784 - DNA, 4805 bp, Homo sapiens
tccggcgccggggctcacttcctggtgcgggaaggggcagagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360785 - DNA, 5199 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaaacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360786 - DNA, 4917 bp, Homo sapiens
atggtggaaagtgaggagaagcaaaaagacgactacttctttccccatttcccggtctggtctttttggggtctactacgtagaggtgcatcagccagcgctaccatggaggcaggaggcattcttttgctctcgtacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360787 - DNA, 4741 bp, Homo sapiens
tccggcgccggggctcacttcctggtgcgggaaggggcagagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacaggcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360788 - DNA, 3895 bp, Homo sapiens
ttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360789 - DNA, 3167 bp, Homo sapiens
  misc_feature (11)..(12): n is a, c, g, or t
  misc_feature (27)..(27): n is a, c, g, or t
aaggaatgatnncaaaactgaacaggnaatgaaaaagcacatggacaatctcaaacagtcaaatatatgtgtaactgaagttccagaaagacaggaaaaagaatagggcagaagaaatatttgaaaagaatcactaagagttttacaaaattggttcttaaaatgttaactcacatggtaaaaaatcttaggttatgccagtcaggatgaacacaaagaaaataacacctagaaaatgactgtaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360790 - DNA, 3476 bp, Homo sapiens
aacaatttttaattagccacataaatggcacctttcccaaatgatgtcctaaatgagactatttgttaattgaatgtggaatagaattgattaattgccacatgtctatagaataatcttttggacatgggtgtgatttgtaaaagatttcttaaatgagggctttagagcaatatctttttttaaaaaagcagtttgaaacattgtatattaggtttaattagataataatcgatctagttttattctaagggttttgctaagttcgttattgtgaaacccagccgtatataaggacatcaccttttgcttttgttccatgttttggttgtggctcttcctgtcgttctcctcctcaccccctgcctgtcgcgcctgtccctccgcccgcccgtcttagcatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360791 - DNA, 3232 bp, Homo sapiens
ttttctgcaaaaacatcatttaaaacaactgttatacacggtagttttttaaaaatcataatgtgtgatgtcttttgtcctggtgtctatgtttagtagcagctcatcagatacagtgtgtgtttgggcttgtcactctgtcccttgtcgccagttgagtttcttgcttacagtacagtattataatttattatttgagataaaaatttttgtattatacacacatctgctacaaatgagctttttttggttcacaaacacagttcctccaccaattctaaaatcatttaatattgactttaataatggtacctttttctagaaaagcactaattgtttttttttttgtgggggggggtcttttttagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360792 - DNA, 5175 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacaaaaaaaaaaaataaaacaagtcat

SEQ ID NO: 360793 - DNA, 528 bp, Homo sapiens
  misc_feature (16)..(16): n is a, c, g, or t
gccacagcgtgaggangggtgaagtgacacgtgtgcttcatagatgaagcatctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360794 - DNA, 2582 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgtaagagctgttgctcatatatctctcaccagaactaatgcacttctgagcttttcttaacaaatgcttgttgtatcgcagcctgcttttcttagatgttttcttgctgttccttgtctcttttatgtgatattttaacaacttttgagagtg

SEQ ID NO: 360795 - DNA, 1822 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcaggtaaaacacaatttaaatttatattttattgtggatctgaggataatttcaaactggctttgaattttgtgttaaatattacgtgtatctatctgtgtatgtgctgtgtgtgtagtgctgtatattcagatatggacgtacagctcctgtttgtgtttcgttgtgactgcaagcatatcctatgttaatttcaaaaaa

SEQ ID NO: 360796 - DNA, 293 bp, Homo sapiens
atcaggaacactgaagagccctcccaaaggatttgatacgactgccataaacaaaagctattacaatgtggtgagtaattgcagaacatttttaaactaactggtttttgactgcctgtaaaactcagcaatgtagaatgtagtgtaaagtacctagaataggaagaaggaaataaagttcattcatctgccacacaaatgtaaccaccattaaggttttggtctgtttccttctaatctctgtatttttgtaattgtatgtttttgttttaatatcatgtatatggaaatgt

SEQ ID NO: 360797 - DNA, 638 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaatcctgcaggcactgcttctcccttccggctggtggttcccaggctggagcgtgtgaaccctgacccgaatctctggaagtgattaaagtttgttttcatcgcccacaagccggccagcagggccgaggaggcaggagagtttctaaaaacgatgtctccctgtagctcaaaatactaaaatcttattcccagggtgtttcttcggggggtggggtggggg

SEQ ID NO: 360798 - DNA, 5151 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360799 - DNA, 4940 bp, Homo sapiens
tccggcgccggggctcacttcctggtgcgggaaggggcagagattggtgcagccccggaggaagaaaaaagggtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaactggtagtaagagcaaagtttaacttccagcagaccaatgaggacgagctttccttctcaaaaggagacgtcatccatgtcacccgtgtggaagagggaggctggtgggagggcacactcaacggccggaccggctggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360800 - DNA, 5328 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaacatggcaaggcactgacctgatgcataatcacgtcttggctgatgatgaccaaccaagcctagactccctggggcgtcgcagtagcctttctcgtttggagccttcagacctctcggaagactctgactatgacagtatatggacagcccatagttacagaatgggttctacatctcgttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360801 - DNA, 4073 bp, Homo sapiens
aaactcacccccatcaccttccgccttttggagtccccagggtctgtcatttccatggtcatgtccatgtgtacccattgtttagctcccaagaaaagacttttaaagataattttaaaaaccaagctttgtttcctctgtttccagcctggttcattccatagcacatctcatcttctgagtcttggtctcgcgtttagcattcgtgatggtttatgtcgttggggtgatgcagaaaccagcctttttttgatatcggtatttaacacgtgcttgacagttgacaccttacctgctctgttgggacttgctttgctcactttgttttttgccgtcgtcttctgtgcttgtttgaaaagctgtttgaagaggtaaggggtgggccattccgttgtgaacactctgagctggtgtgcatgtggcccctgcacagcagccctggccgagcttggctgtgctcctggcactcagagtcaggtagctgagcactcgctcccttttcttctccctgaaacttcaaatattttcttaaagcaattattttttacttatctgtcatttaatgacaaccttagtttcctcctctctttccagttagctgtgccaggggataggtctgtcctagggagcagctgccccctcctctcctcctccctcaggagcgtgcaggatgtctgtgcacaccagcgccagcctgcctcctggtgacacctctcatcacaggactaacaggacccaaatgacacgaggggttttattagaattaaaaaaaaaaaattagccaatgactaatactgaaaatgccctattgatttttaaaaattaacgttcagaagctggtaaagaaaaatcaaagtaggaaaaggcgagaagctcttatcagtggctataataatttggggttttatacctttacagcagcctttctgatatgccagtgaaaatgattggctttagagtatgttagcattttcttttgtctttccctaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360802 - DNA, 3619 bp, Homo sapiens
taaatgttactccgtagctaataaatgtggctagtggatgtcttttgagtgctggggccccagctagagctgcccctcctgtctggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggatcttagtaagagccctaagaccatgaaaaagctgctgcccaagcgcaaacctgaacggaagccttcagatgaggagttcgcgtcccggaaaagcacagctgctttggaagaagatgctcagattctgaaagtcattgaagcttactgcaccagcgccaaaacaaggcaaacactcaattcaagttcacgcaaagaatctgctccacaagttttgcttccagaagaagagaaaattatagtggaagaaactaaaagtaatggtcagacagtgatagaagaaaagagtcttgtggataccgtatatgcattaaaggatgaagttcaagaattaagacaggacaacaaaaagatgaagaaatctctagaggaagaacagagagcccgcaaagacctggagaagctggtgaggaaagtcctgaagaacatgaatgatcctgcctgggatgagaccaatctataagggacgtcctcagttctttctgttgaagaccagttctgaggtgaagctgggcacccctgacccaagtcggggtgcactcaggaccacagggcagggctgggtggggcgccaccttgctctctgtatatagaaaagctggagcttattctgcgaatggagacgatcaaaccatgactgatgaatccagacaggagggattgactctgaggacctgagctacatcaatccactctgtgaacatctcagttacctcattctgcaataagttcagtgactgactaaaagtcttgtttttccagactttgaattgaatatataaatattatatatacatgtttcttgtaaatatcccattttgaatgcatacctgtggtggttctgtccgggctaatccccatgctagaatgtcctttccagctacgtgaataagaagtcccatgcccgcacccaccggaagcagaagcctggtggatgcctggttcgttccgcagcaccagggcctccaccgtgctgtggcagcaccccccatgtcggtatttctaaataaccttatttatacctgcagagatacacttcagtcccattcagaagtcttctcttaaagcagcattacagtcccagacctgcgggtttctgagggcaacttgctggctgacagactcagtcttgacctcaaggaaggcccatacggcactgccgcatccacctagaggtgtttgctcttgtccgctgtctgagtactgtgattctcagatgagtttgctgcgttttgggaggacacagacggttctgtataggctagttcagtaacaacaaaatacactgttttgtcttccctcaaagagagatcttactagaacctgtaaatagaatgtattatttattataagtcactgcagctgatgaaaacagatggaggccatgctgcaggctgatactgatgggtggagttttgtcatcaggccagcctcatcccgaggtctcctccaccattggccgtagccagcaggcttcagtgctcaccgaaagtaaaatcccctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcaca

SEQ ID NO: 360803 - DNA, 3848 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctgtactctgatattctcatcagagtttcagagtccatctgatttctttcagcagtaaagattgtaactactcattggcttttagctagcatttcatttttaatggctctaccattttaaaattctccattctttcatggagatcagtttatcccagggacgtgtgtgtacacgtgtgtttataaagaacagtggatgagctgcttcactcaggttttcaacagcagcctgaaactctacttcatacaattttatatcaagtcagcttttctctgtggccagaccctccgtcttagtgtttctttcactggtggctgggaaggcatcccttcagcggggaaggcactgtgcctcatgtttaaaatgttctgcattctcctacagagtttcttgtgtgggatgatgtattctgtgatccaactctgaccagctgaaatcattttctaattttagcataaagcatacttcctttgactttttcaagaaaggagaaacaaaaccagacactgctttgacgttgttgctagaagggatgtcttacataattttatccatctatacattatttcctatgaaaagatgaccttacagtggcttcatagcatgacctgcatctcacacaattccctcccccatgcagggactagaatgtgatcgttgcaggaagttgatggcttctattcttgaaattgtggcattagctgctgtgtggccgtccctctcagcctgtgttttgaaggtcgcgcacttcctcagaatgccggccccactccgtttccagttcacagcgccacacagcttgttctcccattaaatgcaccttactattgttggctaatttgaggtcattattggctgattttgagaatgacttatttaacttttctcatttaactgtcattgtgatggaatattttgggttttccaggaatataaaatgcattaatggcacaccgctctaagaagttaatttttgattaactttgttttgattaaagttgagttttctaagaacataattggttttaataccagggtttggcagtgttcagtaaagagccagatggtaaacgttctctgctttacaggttcaggcctcttgcagctgtactctgcccttggaacacaacagcagttttagacaggcacaggcctgcctgtgtgccaggaaaacttttttaaaaaacaaaac

SEQ ID NO: 360804 - DNA, 2818 bp, Homo sapiens
acggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtctaccccgagccccggagcgagagcgagtgcctgagcaacatccgcgagttcctgcgcggctgcggggcttccctgcggctggagacgtttgatgcaaatgatttgtatcaggggcagaattttaacaaggtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggacatgaccgataatagcaacaatcaatggttccccagcaactacgtgcgcgaggtcaaggccagcgagaagcctgtgtctcccaaatcaggaacactgaagagccctcccaaaggatttgatacgactgccataaacaaaagctattacaatgtggtgctacagaatattttagaaacagaaaatgaatattctaaagaacttcagactgtgctttcaacgtacctacggccattgcagaccagtgagaagttaagttcagcaaacatttcatatttaatgggaaatctagaagaaatatgttctttccagcaaatgctcgtacagtctttagaagaatgcaccaagttgcccgaagctcagcagagagtcggaggctgctttttaaacctgatgccacagatgaaaaccctgtacctcacgtattgtgccaatcacccttctgcagtgaatgtcctcacggaacacagtgaggagttgggggagttcatggagaccaaaggtgccagcagccctgggattctcgtgctgaccacgggcctgagcaaacccttcatgcgcctggataaataccctacgctgctcaaagagctcgagagacacatggaggattatcatacagatagacaagatattcaaaaatccatggctgccttcaaaaacctttcagcccaatgtcaagaagtccggaagaggaaagagcttgagctgcagatcctgacggaagccatccggaactgggagggcgatgacattaaaactctgggcaacgtcacttacatgtcccaggtcctgattcagtgtgccggaagtgaggaaaagaatgaaagatatcttctactcttcccaaatgttttgctaatgttgtctgccagtcctaggatgagtggctttatctatcagggaaagcttccaacgacaggaatgacaatcacaaagcttgaggacagtgaaaatcatagaaatgcatttgaaatatcagggagcatgattgagcggatattagtgtcgtgcaacaaccagcaggatctgcaggaatgggtggagcacctacagaagcaaacgaaggtcacgtctgtgggaaaccccaccataaagcctcattcagtgccatctcataccgtaaggacttggtgcttctcctccttccagactccaggcgtggcatcccgtggctgagctgtcagcaagtgatcagttgctttaaaacctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgatgatgaaaagggccagactcatgttgaaggcattaaaagaatttatgacacactgttgattttaagaaattgaggtgtcttttacttagaaaagctcaacaagtctttggatatttagagacttttttttttttttttttttttttttttacaacttttcagaatagatgaacactgaagcttcagtgtttaaacctctcctggtgttttgtgctcaagaagttggtatcgggttgttttaacagtcgtcatctttatcaagtaatacggaaaaactgggcagagcttttaaagaatgaatgacgatgacacaggcgttttctgcttacagatttcctcacatccttattaggctattaggatcagctctgtcgtgtgctcagttttcatgttttcttcttcatgtgaaggttgtagctcaagaaggattgctcaggcactcgctctcgctccggggctcggggtagacctgcaacacagagcacaagcgctgagcgccgtggccggcagcggggacgcctcggacaaggccgagcgacgcccacggcccgcgctcccaacacagcgggcgacgctggcgagcggcccccgac

SEQ ID NO: 360805 - DNA, 749 bp, Homo sapiens
tcaagtccaggtgtaagaaggagacagtcaaatggagcacaagataggcccaaggatttgggatgctcaagttgtgggtcagaggctgatgatacaaacaggaatcgggaagacacaaagtaatatggagcagggctggacagcagtatagctctagaagactgacagtcaccagcacacccatgggaaaggagaggtcagagagggccaatggacctgctgggtaaacaatcaggatttgaagattcaaaacaaataaagaagatgattgtaaatactgaactagagttcacagagaagctgtgcagtgcactggaataaatactacattctggcttcaactctgttcctgactactcttaggctgttatgcaaatcattttctctgtataagccccagtttcttcctaggataacttcctccattacagaggcttttgtgaagctcaagtgaaaaaatgtatgtggacatgctttggaaattacaaaatgcctaataaaggtgagaagttggtattattttgctcaccgaagacattggaaataaagtgatcgtgaaaaaatgtcaagatgcccctgatatttttaagtactcattcacctgtctgcctccactaatgggttatatgctcttagattatcgagatgtcaatgtgttctctgtatactccttgtaactatctcattagctgattccttgtggtctactaagtattaaagcaatcaataaaataattgcaaacaacctt

SEQ ID NO: 360806 - DNA, 431 bp, Homo sapiens
  misc_feature (42)..(42): n is a, c, g, or t
  misc_feature (56)..(56): n is a, c, g, or t
agcgacggggcctcccccccgcccccccccccccaatcttanacgagccacgggtnactgcaagaccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctt

SEQ ID NO: 360807 - DNA, 304 bp, Homo sapiens
cgacgcagttccccttagcgccagatggggctccctgagccctgtggctgaagtggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360808 - DNA, 3684 bp, Homo sapiens
ctcctctcctggcccttctacgcctcccctgttccttctcctccccgtcccttctcctcttccctgaccctcagagctctggagaccaccccccatcccctgaccagctacacattttacaactagtgcacttaagttggggaggggtctgttgtgcgtcggtggggcccacgtcctcctcacaacttcttggaatcagtgacccgtgctgtcctggctgccgggcttaagccctccgggaccaaagacacaagctcgagtttcctctaagaaaagaaagcgcccaagaatgtgggggtgaaactcccctgtaattaggatcgccagaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360809 - DNA, 3361 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360810 - DNA, 2079 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctt

SEQ ID NO: 360811 - DNA, 2487 bp, Homo sapiens
cacctgtaatcccagctactcaggaggctgaagcagaagaatcacttaaacctagaaggcagaggttgcagtgagctgacatcatgtcattgcactccagcctgggtgacagagtgagactctgtcgcaaaaaaatttaaaaaatacagtgttttgtattgatatatgtactgtgtgtgtctgtgtgtgtgagatcaagatcaggttttgattggtgatgtactattactgttgtccttggtcagggacacagaggatgtttggggtttggtggtgagacattatctaacacgtgctgtgtcctttttgggtttgagcccccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360812 - DNA, 1546 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagcttgcgccccacaccagcgtgaagcatgagcaccggga

SEQ ID NO: 360813 - DNA, 2467 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactggaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360814 - DNA, 2027 bp, Homo sapiens
  misc_feature (42)..(42): n is a, c, g, or t
  misc_feature (56)..(56): n is a, c, g, or t
agcgacggggcctcccccccgcccccccccccccaatcttanacgagccacgggtnactgcaagaccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360815 - DNA, 1235 bp, Homo sapiens
cccctgggtgtgctatcggacgaggctgggtcattaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360816 - DNA, 318 bp, Homo sapiens
cagaggatgtttggggtttggtggtgagacattatctaacacgtgctgtgtcctttttgggtttgagcccccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctgtgagtaaagccgcagcagggcgtcctgggtcctggactcgccatccccgactgggaggcgcaggtc

SEQ ID NO: 360817 - DNA, 3675 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360818 - DNA, 3316 bp, Homo sapiens
ctcctctcctggcccttctacgcctcccctgttccttctcctccccgtcccttctcctcttccctgaccctcagagctctggagaccaccccccatcccctgaccagctacacattttacaactagtgcacttaagttggggaggggtctgttgtgcgtcggtggggcccacgtcctcctcacaacttcttggaatcagtgacccgtgctgtcctggctgccgggcttaagccctccgggaccaaagacacaagctcgagtttcctctaagaaaagaaagcgcccaagaatgtgggggtgaaactcccctgtaattaggatcgccagaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaaggtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360819 - DNA, 2505 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatcttaaaagaaaaaaaaagaaaaaaaaaaaacaaaagaaaaagaaacaacacaaaacaaagaaccgaaacaaaaaagaaaaaaaacaaaaaaacaaaaatatgaggagggagacacgagccagacaagaaaaaagaggagaaagaagacaacggaggagggagggaggaggggcacacaaagaagtaaacagcacgcagagcgtcaacagcaacgaaacaaagaaaaaaaaagagagaaacaaacaagagagagaggaataaaacaacaaagaaaaaaaaagaacggacgaggataaaagagagagcgacatggaaagaaaacaacaaaagggagagagaaacgcgggagcacataaaggggacagaaacacacgcgggaccaaacaagaaaaggagagaaaaaaaaaaagcaccgcgagcgagaggaga

SEQ ID NO: 360820 - DNA, 2293 bp, Homo sapiens
tggttcagtcggtccatgaggtgtggaccctcgaggtgtgcagcagcacactgcgtccatccggacttctcggactcgcggcggtttggacactcgggcgtgtgcatgcacacgcggaaggtccatccccacaccagtgagaagcatcagcaccgtgaacttgtctgagaatagcagtgttgtcatccccccacccgactacttggaatgcttatccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgtccgactgtgacgaatgatcgctcagcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctgcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaaca

SEQ ID NO: 360821 - DNA, 1493 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgtcccgtctcgtaccgaatgctgaagaatgagacgaacatgcctccacccaggtagcctaacc

SEQ ID NO: 360822 - DNA, 1308 bp, Homo sapiens
aggtggggccgcccggcccgcccagcttcctctggcggcgtccggccgcttctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggtaggagccagttttctcttccagatttcaatcgtgtgtttcctaacttgatctgggccaaatttgcctgtgttggtgggaatcacaggtccccctttattacttccaggaccaccttttcgcacctctatccccttacctttaggggcgaaggtagctgggcacatgtttgttttttgttgttgttaaggtggagtctttcttgctctgtcgcccaggctggagtacagtgga

SEQ ID NO: 360823 - DNA, 384 bp, Homo sapiens
gtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgtaagtctgggcgtgatggtccccgcagggcaccagacggcccctcccttccagagcagccaagctgcaaactgtcttcgtggacatgctcacattttagccaaagttaagtttatggtttagttctagtttagttaactgaagttattcgatcccaggctattttctgtatgtct

SEQ ID NO: 360824 - DNA, 405 bp, Homo sapiens
gtctcaaaaaaaaaaaaaagaaaaagcaagctgtagaaattttacaataagatgctactcaaataagtgtgtgtgtgtgtgtgtgtgtgtgtgtgtgtgtgtgtaacatttacttaggtaatttaaaattattaatttaaatctctcatcttcaaaaattctaaatttagtttcttttatacagaattttagtgtacaaattattgattttttaacaagtataatcaaaaaaatacaatactcacttgaaggaaattttctacctttatcactctaggtttccctgcaaacatctaagagaagctctctatcatatacagaatatatacctatttgtctgatacacaagactatatgtctctaaaagttagcaaagagaatgttacacacatccccaagaatatt

SEQ ID NO: 360825 - DNA, 471 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactggactctgtgacagttgcctggcctcctaaagcctgccgaacaccacaagcctgactcactgttatcccaccacaataaagggccttcgtaaaaaagcatatccgggtttctctctagctgtatgtaacccaccg

SEQ ID NO: 360826 - DNA, 2699 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360827 - DNA, 3044 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacagagcaaagaagaaaaaaaaaaggaaagaaagagtgagaaaatagaagatgaaaagaagaacaatacaaaataagaaataaataaaaaaaaaagatataaaaaggaaagagaaaaagaaaagataaaagataaagagaaaaaataacgagagtaagagacaaacacatataaaaagaagatgtaaaaaaaaaagaaaaaaaataagaataaaaaaaaaaaaaaaagagaacaaaa

SEQ ID NO: 360828 - DNA, 2699 bp, Homo sapiens
gcccgaattttgggatatgtcgaccagcgtcgctgtgctgccggcgcctggtccggaaccgggccctcggcgcttacggcggctcgggcacgggcttctggctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360829 - DNA, 2600 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360830 - DNA, 2462 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360831 - DNA, 2291 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaacccgctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcaaagttcatgtttctcttttagagaatgaattgtttaaatacaaatatgtgcttttttaaaacccttatttttaaatatatatatatattttaaaaaaaccttttaagtaggaaacctctaaggtatttctgagctaaaaaatagcagtgctggatacactttaaagatctttgcaagacggttagagtgactttgctttggagactagaggtgctggagagtagacccagagcaggaggtggctgctgggagccatgatggacgatgtccactccccacacagacataacatgcccttgcttctgagggactctcctatggggaggtggcttgacccacccggtgccaggaggcagggaaggaggtagcttgcaaagcccactttattgagtgctggagcatttacacagcgcggaggaggagataagctggggctgagcaaaccgcacccaaggggttagagggattctgggtgagagggatgagctcccaag

SEQ ID NO: 360832 - DNA, 1471 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360833 - DNA, 2081 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgc

SEQ ID NO: 360834 - DNA, 763 bp, Homo sapiens
agcaaagcagaaagccctgttcctggctggatgcctgggacctgcctcctggggacagaggagcccctctgaggccagctggcgtcctgacgccatggctgccacgtggctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggaggccatgccgccccgagctgtgcatggagaagccgcacccacgggcatgaccgacagcaccgcgtagagacaacacccgggcaagacctatgccacaacagaagacacaccagccgcgcgcacactcacgaaacgcaggacccccaaacaagacaccacaacaaccaaggacaagataaaaaaagcaaaacacaagaacacacgacacaaacgacacgacaagacacaaacacaaccacaaccacgagcacacaaccaacccaccaagacgcgcaaacacacacaccccaacaccacacacaccacgcaacccaaaaaagacagcgcaggcacgacgaccaacaaaaagcgaacaaacaaagacacacacccaccagcgagagcccgcaaacacgcacagaaagagaggagaagagaaggcgagcagaaacaacaccacccacaaaacaacacaaacacaacc

SEQ ID NO: 360835 - DNA, 2736 bp, Homo sapiens
ggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360836 - DNA, 2637 bp, Homo sapiens
ggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360837 - DNA, 3193 bp, Homo sapiens
ggtccaaagtctacccgcctccttgtgacagaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttcaaagttcatgtttctcttttagagaatgaattgtttaaatacaaatatgtgcttttttaaaacccttatttttaaatatatatatatattttaaaaaaaccttttaagtaggaaacctctaaggtatttctgagctaaaaaatagcagtgctggatacactttaaagatctttgcaagacggttagagtgactttgctttggagactagaggtgctggagagtagacccagagcaggaggtggctgctgggagccatgatggacgatgtccactccccacacagacataacatgcccttgcttctgagggactctcctatggggaggtggcttgacccacccggtgccaggaggcagggaaggaggtagcttgcaaagcccactttattgagtgctggagcatttacacagcgcggaggaggagataagctggggctgagcaaaccgcacccaaggggttagagggattctgggtgagagggatgagctcccaag

SEQ ID NO: 360838 - DNA, 2147 bp, Homo sapiens
ggtggggtgggcggtgggttggggggtttcgttgtgcgcgcaaagccgcgcggggctgagggtcttgttctgccggcgcctgtccggacccgggcccctctccgctttcggccggcctcgggcaccgggcttctggagctcccggagccctgcctgttccctgtccatccaggccagcagctgaaggagcctcacctgcctcatcaatgacttcaaggatgtgacgcacacatgccccagctgcaaagcctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagtttagccagttagtccccaggcctgtggccacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcctctgtgaaccctgtattgctggggccggaaggagcccctgagcctagccccttcccgtctgccctgtgtcctcactgcgtgtgggtatgacctctgcctggtggctggtgtatcccaactgggcaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggtagtagattcctattaataaaattatttaagttca

SEQ ID NO: 360839 - DNA, 102 bp, Homo sapiens
attgagtcctatggccatgggatagcacagagccatgactgccatgcttcaatggctgctgtcacagaagctctgagagatgtttttattctttgttttaag

SEQ ID NO: 360840 - DNA, 1422 bp, Homo sapiens
gatttcattttaactgtctttttaatttgtaaaatatatgagtatggaattttgtatctaacttgaaatttcagatgttttaataatccaaatacgttcttctttagcatgtcaaagtactaatagttaaaaaatttctttagatttaagcatatacattacttgactttttcaaaagtatcaaaaaattgatagctgcagaaatgccattatttgattttctaaaaaacattgattcattcttaaatgtgtattctttaaaaaatagtaaatacctcaagagtgacagaaaactttccttttctgttctgtaatgctaatttaaactttgagtcttagtttacatggtcataggggttaaataaaatgtataactgtacaattaattgtgttcttgtgacctgatgattttttgaaaatttgcttttctctttaagaaatttaagttttcaagggccgtattagttatctaaatattttgggctaatgttgacttataaataaataaaaatttagaaatatattcatgatgacaattttgttacttacactgcctattctttatttcttttttagttcaaaggtgaaattttgacctttgtattaacaaagcctcaagaaaagagaaattctgccttttaaacattggttttccttgcattttatggtggtgtgattttgcctcagcaataataaaacataaaatatgttgttgcatcaagttcagtttgtctgctgagattatttttaagaaccaggttgaagcctctatgcctaaaaaagcgtttattgtctggatacatataaagcaagatatatggctacaaataagtcttgcaaccaaaattggtatattaaaatttactgcacactttgagattgctgccattttttggtgctttttggacctcgtcataaagggatgtatcgtatattagggaaaattactcaagttacacattctacattaactgcgctgtattatctacaggtacaatcaatggaccaatagttcctaaattagtaataaggcttaccttacaaaagtaatgaaataacactgatatttctctttcaaaggctaacagcaattcttggtcctgagctattcagttcatacaataactactgtacatgctacaacatctgaatattaatggttttgctgcagattctgggtatgaggattagcttgaaagcaatacatttgctaacatgaatcatgactcacattatccccgtgtgctttactacctgtatatgaatgcaaatgttgttacagaaaatatgcttgaaatgtcaatacagtgtgcaattagcgttgcattgtcatgctccagcatgtgatatctgtatggtgaagttatttcaattactctgatacattactataataaaaaagtttaacctaagaaagctaca

SEQ ID NO: 360841 - DNA, 1633 bp, Homo sapiens
caagctttgtacttagatcttttacttagatctgctttttgtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaagg

SEQ ID NO: 360842 - DNA, 1274 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgatgagacggaagtcctgagagtttgaccgatttaaggtcacgtgcctaggaagtgctggaaccaagactcggagttttctctaatggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtaagatggccttgctaaaatctctctccgtggtctcttttggaatggaggagactgggtcatatcaggaggaagtgttccttcagcttaggatgaaacaagagagaagacataataaagagaacttaaggataaggcaaagctcttttcctgttgccagattccttttctgttaaactcagatgctacagaggctaggtaagttgtttgaatacccaaacgggtcccatctaagaaaaacaatactggagatgcagtgattggtgcttggccagcgtgaaaaggctctggtgagctggagagcctgtaccttgtgtgagtggaatgcctctgcccagctcctgctgatcattgccaggcacaatgtaggcctggtaatcagtgttacctgatactacgatttttatttccagaagaagc

SEQ ID NO: 360843 - DNA, 436 bp, Homo sapiens
ttaaggcttaggcttccttagtaacctgggcgaatgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggtagagacatgtgacgttctctcctacttcacccctttcttatagttggcccttgaattatagctggcaggtatctcagatgtactgaatttctccccttgctaacatgaggaaatggtgcctcagctatttcattggattagcttaaaaggttacagtggcagagatggtgttataacccagtgcct

SEQ ID NO: 360844 - DNA, 2626 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360845 - DNA, 2029 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgatgagacggaagtcctgagagtttgaccgatttaaggtcacgtgcctaggaagtgctggaaccaagactcggagttttctctaatggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360846 - DNA, 2033 bp, Homo sapiens
cgcggggcactctacctaaatgaacctggtcatatactcggatccctacgaaattctggacattagagcgattggatgctcactaattaaaaaaagggctggaggcaaagtcggtgcttgaatcaatcccagatggaccttcagagggcattacagcatctagcagcatgagtccacatgaggtcgatactctaattttatctgcgcaaaggaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360847 - DNA, 1697 bp, Homo sapiens
ttaaggcttaggcttccttagtaacctgggcgaatgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360848 - DNA, 2921 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360849 - DNA, 2537 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360850 - DNA, 2470 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360851 - DNA, 2581 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggagggatcccgttggacaacgatcgcgtcgtcggtatacgtgcctgacgcgtgaagccttgcctttacagacccaggatcatgccgaggatcgtccgatgcatagtacgcacagctagctggattcttcgcgtgacatatgcgccagtcttcccagaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360852 - DNA, 1930 bp, Homo sapiens
atctgtacccctcacagcaggttctcctggagggtgatctgagcagcataccttcatgcccactgcagtgaacttggaatgtgagtgctttgagaggagagaggaagagctttgtcagttttgttcattgctgtattcctaggccctcaaacagagcctagcatgtaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360853 - DNA, 2055 bp, Homo sapiens
atctgtacccctcacagcaggttctcctggagggtgatctgagcagcataccttcatgcccactgcagtgaacttgggcaagttgcttaattttttgaagcttcagcctccttatctgtaaaactggagtagtatttatggttttgaagagtaataggatattatatgtgaagctcatagtgtgaagcctggcatatcatagaatgtgagtgctttgagaggagagaggaagagctttgtcagttttgttcattgctgtattcctaggccctcaaacagagcctagcatgtaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360854 - DNA, 1352 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360855 - DNA, 1509 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtaagatggccttgctaaaatctctctccgtggtctcttttggaatggaggagactgggtcatatcaggaggaagtgttccttcagcttaggatgaaacaagagagaagacataataaagagaacttaaggataaggcaaagctcttttcctgttgccagattccttttctgttaaactcagatgctacagaggctaggtaagttgtttgaatacccaaacgggtcccatctaagaaaaacaatactggagatgcagtgattggtgcttggccagcgtgaaaaggctctggtgagctggagagcctgtaccttgtgtgagtggaatgcctctgcccagctcctgctgatcattgccaggcacaatgtaggcctggtaatcagtgttacctgatactacgatttttatttccagaagaagc

SEQ ID NO: 360856 - DNA, 369 bp, Homo sapiens
gtgggttgtattaggtcattgcatctttgaagctttatgattttaagtgtagttgaagaaggtaattgggctttttgttattggtccactaggaattggcctggattaggagtcttagagtacctggaatccggtcccatctctaccaccaactggctgtttgaccttgggcaagttgcttcactctctgggcctccatttcctcatctgctaatataaggtgaaggaatcctcctgttcttattgtctatttcagtagttgtattccaaagtcatagaccaaggttggacctgttgtatttgacaaactaggctagagataggagaaagggaaagcccttgctgtgaacacactgtttcaaatcaaag

SEQ ID NO: 360857 - DNA, 569 bp, Homo sapiens
aatcaggctgtctcattttgtgttcttgcagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccac

SEQ ID NO: 360858 - DNA, 1190 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtaagatggccttgctaaaatctctctccgtggtctcttttggaatggaggagactgggtcatatcaggaggaagtgttccttcagcttaggatgaaacaagagagaagacataataaagagaacttaaggataaggcaaagctcttttcctgttgccagattccttttctgttaaactcagatgctacagaggctaggtaagttgtttgaatacccaaacgggtcccatctaagaaaaacaatactggagatgcagtgattggtgcttggccagcgtgaaaaggctctggtgagctggagagcctgtaccttgtgtgagtggaatgcctctgcccagctcctgctgatcattgccaggcacaatgtaggcctggtaatcagtgttacctgatactacgatttttatttccagaagaagc

SEQ ID NO: 360859 - DNA, 1945 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360860 - DNA, 2264 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360861 - DNA, 1717 bp, Homo sapiens
caagctttgtacttagatcttttacttagatctgctttttgtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagc

SEQ ID NO: 360862 - DNA, 1566 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaagg

SEQ ID NO: 360863 - DNA, 3151 bp, Homo sapiens
tgtaagacctcttagcgggcccatcgctgaggtgcagggacatgtcgcggccgaactcacctcgtggcctcggcgtggtgctctcagctcatgcccggaaaccaggtcccgacgccgcggtcagacggacctctagacgcgtccgcctcaatgccgccagctgccaggccgcccgtgacgcgttaagcctgcgccgcctcctggcttcgtgacgtcacgacgtccgcgcagctgcggtcgccgccgtcgcacgagtctttccttagtaacctgggcgatagctgatgagacggaagtcctgagagtttgaccgatttaaggtcacgtgcctaggaagtgctggaaccaagactcggagttttctctaagtttagtgcctttattttgttttaaaccacactgttgcatttccccccattttggaaagctttatagttggaaagaatgaaaacctgatctgaccccttcattttatggttgaaacaaaatctacgtaggagaaatcacttggtacaagtcacaagtcagtggtagagctgccgcaaatgctttttgaatacgtgtgattatgaatctaaatggcagatggcagggagtgataagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagactatgaagcaaataaaacaatactttaatgggccaaatgtggcctgagggccaccaatttgtgacctctgcattagtatttggagcagaccctccaggaagtccttttatactagactgaccattgcagaatattgcatggagcacagtgcttccaaaactggaaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360864 - DNA, 2526 bp, Homo sapiens
caagctttgtacttagatcttttacttagatctgctttttgtcttattctttttagtggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagaggaattggcctggattaggagtcttagagtacctggaatccggtcccatctctaccaccaactggctgtttgaccttgggcaagttgcttcactctctgggcctccatttcctcatctgctaatataagtgtacagctgcagctatcaaggctataagagaaagtggaatgaatctgaacccagaagtggaagggacgctaattcgggtacccattccccaagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360865 - DNA, 2018 bp, Homo sapiens
tatacatggatgtcctatggcgtagactcggtatatctcaaattatcgccccagcccgtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagagtaaccagagagcacagagaaatgctggtgaaactggccaaacagaacaccaacaaggccaaagactctttacggaaggttcgcaccaactcaatgaacaagctgaagaaatccaaggatacagtctcagaggacaccattaggctaatagagaaacagatcagccaaatggccgatgacacagtggcagaactggacaggcatctggcagtgaagaccaaagaactccttggatgaaagtccactggggccagcaatactccagagcccagtttctgctggatcccatgggtggcacattgggacttctctccctcccccatctacacagaagactgtcaccatgctgacagaagcctgtccttgtaaggcccagccttccaggggaacactcagacatgttcattctcttcctgcttctgctctgggccggtgggtggctctcagaaaatacttgctgctggcaaaaggcctgtactcaggcatttgctttgacttgatgttgccaagggactgaggccattggcaggcttagtaccacctgctcctcatcttaggagtctccttttcaaataattaggctctgttcccattttaaaactctgatattggccttcacctgtgactggacactttactagaggcccattttcactaaacaataaaatctaaataaattggaaggaataacaaccacaaaggaaagaatagagttggtctggattgatgatcactgaggatctgtatgtgaggcacccataacagtagttttgcctgtgagtcgtcttcacacatgctgttttctctgcctggctctctcttcccctccttacctggccagtcctgtttatcatcaggccttgtcttggatatcacgtcctctgggaagtcttcttttcccctctaacctaggaccctcattaccggctctcatagcacagtctactgctttgtacgaattctaagtattcttgttgcacttaattagcctgtatatcctcagaactttgtgtaatgcctggagcatagtaggcagtcatatgttgtatcgtgaataaattgcacatagtagctacccagcaaatgctgacttcttttctttctagtcttaacactccctttctatcattttccactcttgtacttgttctcaacatttacttggtagtgacatacctttcctgcagggcctgcccattgttgacagacaagtagtttattgtggcttatcttcggatactgggttattaggtttttttccctccaattattttttattcattcattcattcctaatatagccattatgagttaggtatagttctaggcattatttataatcttgacagtaaacttaagagatgtgtattatcttcatttacaaataggaaaactaagtcttgacagtattaggtaatttgcccaaagtaacaaagcaaagctgatcagtggtagaaggttttcatgattcattgtcagcgtcatttacatagaggtgaagtttcttgtgcagggttacacacctagcaagtagcagagctggcattcaaattgaggcctgatgtgctaatgtaaaaggaaaaaaacaaactttttttccttttgtactttcacactcaacatggaacacttctgtgacaaggtgtgtgagtttgtttcccccacacaccaagcaattctccagcagacaccaactgggtatcctataattcaattcatttctgacattacctggaaatagtgtcagatcccacaggttgag

SEQ ID NO: 360866 - DNA, 982 bp, Homo sapiens
tgtgcctggcttatttccctaaacataatatcttccaggtccccccacattgtagcacgtgccagaccctcgctcccgtcgaaggctgatgccatccttcagtgatgtgtggacggacacattccgcgtatcccccaatcagtggatggacgcgtgggttgcagagcacgccacacacattcagtcagtacacgagttaacagttgcgtgcttgtctgcctgtgtcatccattcgagcatctgccaaggacccaggaaacacacagtgtgtctcctgaaggaatgaaaagccctcctggcccctctgccctctttctccaccctctccattttcaccgagatggttgtggtgtcacctctcgtggggtggccaaaaccccagccagggccacctatcccttcacctccctccacctcggatttcctcttggaaaatgaggctcctgactcacttgacctactgcgtaggctcctaaaagggtgtcggcaagttggcaagttaaaaaaaaaaacaatcagcatgaaagcactccgatgtatgcatacttttacttcgcgttggttccctacgttcttagaacaaggaaggagtgtgagtacttgctttggattgaaaggttttccagactagctgtaggaagtatgaaagtaaccaaggtctcacacacagccccagcactctgggtggatttcacttcatctactccactcacctacgctgagcttccctgtggacaagctcgtccatcctctttaatcactcccaggcctcgctcacacagcaacaagtgcctgtccctgtgtccttgctgttggcaagcagaagttccctggcagcctttgaacatagctgaatgttaggtatctttgatctgtctaaggaaaaagtctattttaaactgtgaagtgaagccaatttttttaggtcagattcttacccaacaaagcatacatcatccgtgctcatatagtttccagttta

SEQ ID NO: 360867 - DNA, 189 bp, Homo sapiens
aatgcagcccagcccaagcttagctccctccccagtcccactctagatgcacacgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360868 - DNA, 939 bp, Homo sapiens
tctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggctcacctctccatcggagatgaccctggacctctttcggcagagaggtctcggcatccggtgtcccgccgcacttcttcctcccactggtactgtgtcgcccgtccaccgcggacggcggcgggggtcccggccgacgggggaaccgcctcgggtgtccgccccctccttgcgccccgcgcctcgcgctctccccggtcctgtgtccagta

SEQ ID NO: 360869 - DNA, 437 bp, Homo sapiens
atttggtaaatcacttccctctaggtcttccccctttgaatcctcttggtggcatcagcagggagacacagaagtgtctttcctctttggagccagatatttttccagctgcactcctaggcagaggccagtgagggagtgccaggggctcactgccttctccccaacactgtgtctttaggtgtcctgtgatgctggtggtaggagaccaagcacctcatgaagatgcagtgggttagtagggaattttggggtgagtgagggaggagggttggggtcctaaagtggtggtcagaagagtatcttgccaaggggatgtcctgtttggcacagggagatcaactttggggcactaagaatttgattcctggtaagggaggaggaggaattcgcccaggaggaggaggaattcgccccggaggaggaggaattcgccc

SEQ ID NO: 360870 - DNA, 2716 bp, Homo sapiens
gtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccgtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcaggtgagtgccgctgccgtccatgggatggggaagggacataggataccggtggcactgggctctgccctttgccacacacccggccccacagtgccgcagcctcaggctccagctcttcctctaacctcatctcaccgtctccctcgcctcttcttacttccgcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360871 - DNA, 2404 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360872 - DNA, 1928 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggagatcaactttggggcactaagaatttgattcctggtaaggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360873 - DNA, 2360 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccgtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggctagagtgaagaagctagggaagagagaccctttccacctctctgcatggctcatttatgtgtgtttcactttttctgggtggtgctctcctgaacagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360874 - DNA, 1852 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360875 - DNA, 2161 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgaaaaaaaaaaacacacacacaacacaaaataaaccaagcgacaacaacaacaacgaaatagtaaacggacatcacactaacgacccaagcacaacacaaacaaggagggggcgcggacggacaaacatcccccgcgggggagcgcacacccacccagggccacccgagttgctctgcagaacagggggcccaccaacgacaggcagaataaacaccagcgaggccgcgcggtaacaaccgtgcgaggggaaaacggcggcggcgagctggcgaaac

SEQ ID NO: 360876 - DNA, 1721 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctcccaaagtgctgggattacaggcatgagccactgtaccctggcctgtagttgtatttttaaatttttgaaacctctgtactgttttccataatggctgtactagtttaagttcccaacagtgaacaagggctcctttttctgcacattcctgctaccaacacttgttatcttttgtctttttgtttgtttgtttttgagacagtcttgttctgttgcctaggctggagggcagtgacacgatcatagcttactgcagcctcaactcccaggctcaagcagctctctcacctcagcctcccaataggt

SEQ ID NO: 360877 - DNA, 1457 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360878 - DNA, 1404 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggacttgacctttaacccgtgattccccccagctcggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360879 - DNA, 1477 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttattattctttgt

SEQ ID NO: 360880 - DNA, 1187 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccgggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360881 - DNA, 1144 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360882 - DNA, 1139 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaaggtcagtaacctgttcctgggcccccgtccacagtcatatatcctctctacatgcagctgctaagcctccagggcccggcatgggagcaaatggggtgaacgaagaacaaaacaaaggggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360883 - DNA, 655 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacacgttcgcgagggggatcctct

SEQ ID NO: 360884 - DNA, 1652 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggtggaatgtaactcaaaactggacccaacagactcgttcctcaagatggctgaatccggaggtcagcccagtgagtcagcaaggaatgctgaccgaggcctacaagtaattcctgcaggcatgggtacatgaccatcggcatgaatcgcatgtccaggctcgtaaaggcatctctgaccaggaagcatccgagaaggaacggcccggccgagcctgtccagaacaggaggttgaaaccttattgggccggggaaccaggcggcctgagagggccgggccagggaacgacagcacaaaatgagggaaggaaggcacaagaaaggaaaggggaaggtaggcaaccaacaaccagtcaggactgaaccaccacaagg

SEQ ID NO: 360885 - DNA, 720 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggctcacctctccatcggagatgaccctggacctctttcggcagagaggtctcggcatccggtgtcccgccgcacttcttcctcccactggtactgtgtcgcccgtccaccgcggacggcggcgggggtcccggccgacgggggaaccgcctcgggtgtccgccccctccttgcgccccgcgcctcgcgctctccccggtcctgtgtccagta

SEQ ID NO: 360886 - DNA, 2102 bp, Homo sapiens
attccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360887 - DNA, 1886 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360888 - DNA, 1911 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaagtgggtgggctgtgtgtgtatgcatccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360889 - DNA, 2661 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttcttttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggggtttcaccatcttggccagggtggtcttgaactcctgacctcgtgatccacccgcctcggcctcccaaagtgctgggattacagacgtgagccactgtgcctggccaataccctgaactttctcacctgccttctcctcatagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccgtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360890 - DNA, 1356 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctctccccatttgtgtaggtggaggcttgatcttgcgatagggcaaagaggtaagtgga

SEQ ID NO: 360891 - DNA, 636 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaaggggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 360892 - DNA, 528 bp, Homo sapiens
agtagtcgccggtaggctggaggctcggcgtggccgtgcgttgaacgaccgtgcgtgactgggactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccaggttcaccgtggttcctgagccagtttcagcttctgaactcaatatatcttcttccttcatgctcccgccttgattattgagaaaaggtggtgggtttggaaaatt

SEQ ID NO: 360893 - DNA, 384 bp, Homo sapiens
gctgctttcctaccataacgggcggaattgagtagttgtgactgagacaatatggcccacagagccaaaaatatttactatctggtcctttaagaaaaagtttaggctgagggtggtggctcatgcctgtaatcccagcactttgggaggctgaagtaggaggatcacttgagaccaggtgttcacgaccagcctgggcagcacagtgagactccgtccctactaaagaaaaaattagccgggcatggtggcacacacctgtggttctagctactcaggagtctgaggcaggaggatcgcttgagcccaggagttcaaggctgcattgagccatgattgtaccactgcactctggcctgggtaacacagcaagaccttgtctca

SEQ ID NO: 360894 - DNA, 2600 bp, Homo sapiens
tatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaa

SEQ ID NO: 360895 - DNA, 797 bp, Homo sapiens
gcacaagaccgctctacagtctcatccaagacttgaagagctcccgacttgtaatactacttgtgtttaccagggactgttgacactgcttcgcttccgaagaccgttagggacgtgggattaggtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaa

SEQ ID NO: 360896 - DNA, 584 bp, Homo sapiens
aagggtttttttaaaaaaaaaaaaaaaaaaccccccctttttgggggaaaaaaaaaaaggttccaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactg

SEQ ID NO: 360897 - DNA, 2276 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcatttcaatgcatgatccttttcttgcctcccttgtgtcagggtgggcattacatatacttttctttttttttttttttgagacggagttttgctttcgtcacccaggatggagtgcaacggcacaatctcagctcactgcaacctccacctccccagttcaagcaattctgctgcttcagcctcccaagtagctgggattacaggtgtgtgccaccatgcccggctaacttttgtatttttagtagaaatggggtttcaccacattggccaggctggtctcgaacttctgacctcaggtgatccgcctgcctcagcctcccaaagtgctaggattacaggcgtgagccaccgcgcctgggcacatatcttacctacattttcgtatatcttcaggaaacaatcccatctgccctagtttgggaatgtttaagagttgactgttatactgtaatggagttcatgtttgtgttttgttcaaaagctgacagtcaaatatgatagattccaaggcttgccaatgataaaaagggaaccaaagttaatgtcttatgcctaatgaatcctgaaatgaatccaagcatttgcaggaaattctagttgatgcatacatacaccaagcagtttagtaaaatggaagtggactaaaacttactaatcaactggcttatgaatggatttcatttgataccattttaaacctatatttaagagaatgctaattagcctgtatgtttaaatttaccaaagtgatttctatgttttgtatgttaatggaagtagaagcaatgttctgctttaaaattgaactgttgaaatacggataatacaagaaaatatacaatttattatagtcaaaggaaaatgaagaataggcttgcttcgtgttaaagcagccaaaaattcagagatttcacttatttaagattttgggcaattcacacacatactttgatatttctgtgtagtcaagcataacatagctatttactgtgtacatttcacaaagataattaaatatgtgctcacctggcaaataaggg

SEQ ID NO: 360898 - DNA, 1082 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactg

SEQ ID NO: 360899 - DNA, 986 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaa

SEQ ID NO: 360900 - DNA, 1270 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaaaaaaaaaaaaaaaaaaaaaaaaaaaaaaaaaaaaaaaaaaaaaaaaaaaaaaagaaaaaatcagaaaaagaagaaaaataaaaagaatagacaaaaagatgaatcggagagacagaatacagcaatcaaccacgaatagggacacagacagaagaaaagagcaaacgcgagggaatcagtggtgcacggacagcaggggcagcgcgctcagaacgcccacaccccacaccatgtcgtgatgcaacgggttacaagaggagcgaggaaggggtgcccgcgcggtg

SEQ ID NO: 360901 - DNA, 1034 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggatatccatagagggctatgtcagggataatagatgacattgtggctatgatagagtggcatgttaaataactgttttaaaaaaaaaagaaaaattgggggggcaaattaaattggggggcaaaaagggaacgaagggaaagggtccaaggggtaaatgttgtacgg

SEQ ID NO: 360902 - DNA, 2188 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcatttcaatgcatgatccttttcttgcctcccttgtgtcagggtgggcattacatatacttttctttttttttttttttgagacggagttttgctttcgtcacccaggatggagtgcaacggcacaatctcagctcactgcaacctccacctccccagttcaagcaattctgctgcttcagcctcccaagtagctgggattacaggtgtgtgccaccatgcccggctaacttttgtatttttagtagaaatggggtttcaccacattggccaggctggtctcgaacttctgacctcaggtgatccgcctgcctcagcctcccaaagtgctaggattacaggcgtgagccaccgcgcctgggcacatatcttacctacattttcgtatatcttcaggaaacaatcccatctgccctagtttgggaatgtttaagagttgactgttatactgtaatggagttcatgtttgtgttttgttcaaaagctgacagtcaaatatgatagattccaaggcttgccaatgataaaaagggaaccaaagttaatgtcttatgcctaatgaatcctgaaatgaatccaagcatttgcaggaaattctagttgatgcatacatacaccaagcagtttagtaaaatggaagtggactaaaacttactaatcaactggcttatgaatggatttcatttgataccattttaaacctatatttaagagaatgctaattagcctgtatgtttaaatttaccaaagtgatttctatgttttgtatgttaatggaagtagaagcaatgttctgctttaaaattgaactgttgaaatacggataatacaagaaaatatacaatttattatagtcaaaggaaaatgaagaataggcttgcttcgtgttaaagcagccaaaaattcagagatttcacttatttaagattttgggcaattcacacacatactttgatatttctgtgtagtcaagcataacatagctatttactgtgtacatttcacaaagataattaaatatgtgctcacctggcaaataaggg

SEQ ID NO: 360903 - DNA, 2298 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtttcagggatataatcagaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcatttcaatgcatgatccttttcttgcctcccttgtgtcagggtgggcattacatatacttttctttttttttttttttgagacggagttttgctttcgtcacccaggatggagtgcaacggcacaatctcagctcactgcaacctccacctccccagttcaagcaattctgctgcttcagcctcccaagtagctgggattacaggtgtgtgccaccatgcccggctaacttttgtatttttagtagaaatggggtttcaccacattggccaggctggtctcgaacttctgacctcaggtgatccgcctgcctcagcctcccaaagtgctaggattacaggcgtgagccaccgcgcctgggcacatatcttacctacattttcgtatatcttcaggaaacaatcccatctgccctagtttgggaatgtttaagagttgactgttatactgtaatggagttcatgtttgtgttttgttcaaaagctgacagtcaaatatgatagattccaaggcttgccaatgataaaaagggaaccaaagttaatgtcttatgcctaatgaatcctgaaatgaatccaagcatttgcaggaaattctagttgatgcatacatacaccaagcagtttagtaaaatggaagtggactaaaacttactaatcaactggcttatgaatggatttcatttgataccattttaaacctatatttaagagaatgctaattagcctgtatgtttaaatttaccaaagtgatttctatgttttgtatgttaatggaagtagaagcaatgttctgctttaaaattgaactgttgaaatacggataatacaagaaaatatacaatttattatagtcaaaggaaaatgaagaataggcttgcttcgtgttaaagcagccaaaaattcagagatttcacttatttaagattttgggcaattcacacacatactttgatatttctgtgtagtcaagcataacatagctatttactgtgtacatttcacaaagataattaaatatgtgctcacctggcaaataaggg

SEQ ID NO: 360904 - DNA, 2200 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcatttcaatgcatgatccttttcttgcctcccttgtgtcagggtgggcattacatatacttttctttttttttttttttgagacggagttttgctttcgtcacccaggatggagtgcaacggcacaatctcagctcactgcaacctccacctccccagttcaagcaattctgctgcttcagcctcccaagtagctgggattacaggtgtgtgccaccatgcccggctaacttttgtatttttagtagaaatggggtttcaccacattggccaggctggtctcgaacttctgacctcaggtgatccgcctgcctcagcctcccaaagtgctaggattacaggcgtgagccaccgcgcctgggcacatatcttacctacattttcgtatatcttcaggaaacaatcccatctgccctagtttgggaatgtttaagagttgactgttatactgtaatggagttcatgtttgtgttttgttcaaaagctgacagtcaaatatgatagattccaaggcttgccaatgataaaaagggaaccaaagttaatgtcttatgcctaatgaatcctgaaatgaatccaagcatttgcaggaaattctagttgatgcatacatacaccaagcagtttagtaaaatggaagtggactaaaacttactaatcaactggcttatgaatggatttcatttgataccattttaaacctatatttaagagaatgctaattagcctgtatgtttaaatttaccaaagtgatttctatgttttgtatgttaatggaagtagaagcaatgttctgctttaaaattgaactgttgaaatacggataatacaagaaaatatacaatttattatagtcaaaggaaaatgaagaataggcttgcttcgtgttaaagcagccaaaaattcagagatttcacttatttaagattttgggcaattcacacacatactttgatatttctgtgtagtcaagcataacatagctatttactgtgtacatttcacaaagataattaaatatgtgctcacctggcaaataaggg

SEQ ID NO: 360905 - DNA, 1006 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactg

SEQ ID NO: 360906 - DNA, 616 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaagtaagaatcaggccttattggagacattcaagcaaaggttggacaactacttttccagaacagaaaggaaactcatgcatcagaaaaggtttcagggatataatcagaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagaggtatgaaaagtgttactcactaaaattctaca

SEQ ID NO: 360907 - DNA, 687 bp, Homo sapiens
gcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaaccgccagccttgtactgatgtcggctgcgagagcctgtgcttaactgggcaacagagtgagaccctgtgtcaaaaaaaaaaaaattagaatagagttgtgacaattatatgaaaggacatttgaaaatcctgcttgtgctgcttcttcacttgaaataatttattatttcatatatgggaaataatattaacaatttattattaataattattgatttatatcaataaatgatagtgtgacttagttatggcttaatatgaatataattagattatattataattaaaatatgattaatttatattaatataaatcatttattatttcccatatgaactgccattgactgattttcttgtcttcaacttcctttctccacactggaaccagaattgtcttatttaaaaaataaaacca

SEQ ID NO: 360908 - DNA, 401 bp, Homo sapiens
aaatattcaactagaaaataaaactattctgtagatcatactgtacccatttaagttagcataataactatgatttcaagtgttatagtatattttgtctaaatataaaataccagtaatttaagtttcaaagcatctttgttttaaaaaccaaatactaaagaacattctggtttgtttgtagtttaaggaatttctggggacctacaataaacttacagagacctgctttttggactgtgttaaagacttcacaacaagagaagtaaaacctgaagaggtatgaaaagtgttactcactaaaattctacaagccttcataaacactctaagtaggatccccttaagcatttcacttgttcctacttattacaggaatttagactaccttttatgttcca

SEQ ID NO: 360909 - DNA, 399 bp, Homo sapiens
tgcccaggctggtctggaactcctggtctcaagtgatcctcccatcttggcctcccaaagtgctgggattacaggcgtgagccactgtgcctggctccccgaaactatgcttttgcttgggtctttcagctggttcatctcttcagcactgctgaataaatttagccagatgattggtgttttgggagacagaagctccctaaagacagaagcaagccaccatacttacatttcaagtccctggtggcagatggagaaaaaggacctaccccttcatttttcacccctcacgcctctttcaggtgttggtagaaattgaccaagtgaagtccagatcactgctccgatctctcagaacagattagagatcactgagccaggatcctctagatcaccagc

SEQ ID NO: 360910 - DNA, 241 bp, Homo sapiens
ctattttatttatataaaaataaaatataataaataaaaaaaaaaaaaaaaaaaaaaaaaaaaaaaaaaaaaaaaaaaaaaaaaaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360911 - DNA, 2766 bp, Homo sapiens
aactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctc

SEQ ID NO: 360912 - DNA, 1681 bp, Homo sapiens
tgagctggccccccgttcgatggccatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360913 - DNA, 2249 bp, Homo sapiens
atacatactcgttgcctttaccaccccaggactgggtgcagtggcacaatcacagctcacttcaaccttgatctcccaggctcaagcgatcctcccacctcagcttcccagtagttgggactacaggtgcatgtcaccatgccaggctaattttttgtagagatggggtttcgccatgttgaccaggctggtctcaaactcctgggctggagcaatctgcccacgtctgccatccaaagtactgggattacaggcttgagccactgcacccagcccccttttgctacattctttggagcgtctgataaggagaatttgaatcgtagctcgagagccagaggaagagatgccatcttaataatcacagaaaaagaggaaagcaatgaaaaacattaggatcaagtagacagacattcgatcatgcttttctgccaggagtgaatttccatgatcccactgatgacttagactgttctcccttgattcaggctctagagaagcattcaaacgttgggactatatttctgacatcgttattaagtgattttactacagatgagaaggcttggaggtcttcccctatctcagcattgtctgttctaaagcctaatgcagctttgtctgtatttgctgaccaggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360914 - DNA, 2122 bp, Homo sapiens
aactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacgtgagtttctcactgaccacatcaatttttcccgggtcctgcctccaactcaagcatactgagtgtgggcttaaccctccctgttccaagagctttgggaagatcccgctttaactttcccaagccggaaagagccactttcca

SEQ ID NO: 360915 - DNA, 1591 bp, Homo sapiens
aactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggtaaagtcgcagtgtcctggggccactgaggaagcattctgttagccagggtcttggccacgtctgggagagggctgggggttgggatccggggtgctgaaatatgacctttaagcacttgtgggctcttgtaatcccaatgtaaaatgagaccatatatttgctaccaattttctattgattgatggattgagacagagtctccatctgtcgcccaggctggagtgtagtggtgcgattgattacaactcactgcagccttgatctcctgggctcaag

SEQ ID NO: 360916 - DNA, 854 bp, Homo sapiens
ggatgggagtgatgttggttagttctttattaaattagagttcctagactcgagccaagctcacagtctggtctgacactgtgggaagaacctggtgagtaaagggcctattgagggcagggttggcgccccacatctagggacttggcagggcagcttctctgtttcgtattcaggggaggccctgtggggctctgacctgcttggtgctgagtctgtggagctctgtctgtctcctctccgcccccacagactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360917 - DNA, 984 bp, Homo sapiens
atacatactcgttgcctttaccaccccaggactgggtgcagtggcacaatcacagctcacttcaaccttgatctcccaggctcaagcgatcctcccacctcagcttcccagtagttgggactacaggtgcatgtcaccatgccaggctaattttttgtagagatggggtttcgccatgttgaccaggctggtctcaaactcctgggctggagcaatctgcccacgtctgccatccaaagtactgggattacaggcttgagccactgcacccagcccccttttgctacattctttggagcgtctgataaggagaatttgaatcgtagctcgagagccagaggaagagatgccatcttaataatcacagaaaaagaggaaagcaatgaaaaacattaggatcaagtagacagacattcgatcatgcttttctgccaggagtgaatttccatgatcccactgatgacttagactgttctcccttgattcaggctctagagaagcattcaaacgttgggactatatttctgacatcgttattaagtgattttactacagatgagaaggcttggaggtcttcccctatctcagcattgtctgttctaaagcctaatgcagctttgtctgtatttgctgaccaggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtaaggctggggaactggggaccagacgggccacattggagcagtgtctgtcccagataaaaatgcacgtgttctgtatttgttctctgaaccctgggaaacacttgcacctgaacccaagaggatgttgttaaggatattcatagtggcattgtttgtaatggtggaacatttgaaacaacgtaaatgtc

SEQ ID NO: 360918 - DNA, 342 bp, Homo sapiens
acctatgttgacgtacccaataaggttccctttgttctgtctctgcaggtgcagcttttagcagcctggcaagagctgtgtcaaagtgacctatccctggaccggcagcttaccggactctatgatgccttgcttggtgcttggcacacacaaatccagtgggctacacaggtaacagctcatttttgttctagggagaacagagtctgtggtgacaagggaacgggtgactgcctcgggagtggccaccctcaactgcagagcacagctcaaagaacttccccgtttgttgctgtcattcaaggggttaaaaaataaccagttaggccgggtgcggtggct

SEQ ID NO: 360919 - DNA, 654 bp, Homo sapiens
ctgaactgattgtaggagaagcttccatgaatgataaaagctgcttaacaaaatatagtcccctctggagatcaaatggggaaagttctagtagagcgcctcttgattgttgctttcccacagttaatttcagattctttgttcattatcgttttacatttctgattccctaaagatgaacacaatctggtaaaagtcacggagctggtggatgctgtgtatgatccatacaaaccctaccagctgaagtatggcgacatggaagagagcaacctcctcatccagatgagtgctgtgcctctggtaaagtcgcagtgtcctggggccactgaggaagcattctgttagccagggtcttggccacgtctgggagagggctgggggttgggatccggggtgctgaaatatgacctttaagcacttgtgggctcttgtaatcccaatgtaaaatgagaccatatatttgctaccaattttctattgattgatggattgagacagagtctccatctgtcgcccaggctggagtgtagtggtgcgattgattacaactcactgcagccttgatctcctgggctcaagtgatcctcctgcctcagcctcctgagtagctgggactccaggcatgcaccaccacgcctggctcatttttgt

SEQ ID NO: 360920 - DNA, 938 bp, Homo sapiens
aatattgaggtcattataagaaggatgaatctataatctatatgcaagctaccagtgattcttttttagggtactgccataacaagcatcgccacatactagaaagatcagacttgggatcacccgaggtctagcaattttgtctctctgccgtttgccttcacacaaatgtacccataaagtaataacccgtatgtgtcaatgtcaggctaacagcgctttcttttgtttcagatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctc

SEQ ID NO: 360921 - DNA, 2923 bp, Homo sapiens
aactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360922 - DNA, 2732 bp, Homo sapiens
tgcccaggctggtctggaactcctggtctcaagtgatcctcccatcttggcctcccaaagtgctgggattacaggcgtgagccactgtgcctggctccccgaaactatgcttttgcttgggtctttcagctggttcatctcttcagcactgctgaataaatttagccagatgattggtgttttgggagacagaagctccctaaagacagaagcaagccaccatacttacatttcaagtccctggtggcagatggagaaaaaggacctaccccttcatttttcacccctcacgcctctttcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360923 - DNA, 2054 bp, Homo sapiens
gtctcgatagtagtgtcctgggagatcccggatcagttatccggattatactcattagctcctgcacgtactcaatgcgggtgacctccatgaaatcgtcgtataagtcaatctgtgaatcgaggccaagcgaatagaggatgacgttgagcccagaatactcagctcagaaatgagtaatcatgtgcatagcattagtcctcgatgtaaaatggatattcgatcatgcttttctgccaggagtgaatttccatgatcccactgatgacttagactgttctcccttgattcaggctctagagaagcattcaaacgttgggactatatttctgacatcgttattaagtgattttactacagatgagaaggcttggaggtcttcccctatctcagcattgtctgttctaaagcctaatgcagctttgtctgtatttgctgaccaggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360924 - DNA, 1095 bp, Homo sapiens
aatattgaggtcattataagaaggatgaatctataatctatatgcaagctaccagtgattcttttttagggtactgccataacaagcatcgccacatactagaaagatcagacttgggatcacccgaggtctagcaattttgtctctctgccgtttgccttcacacaaatgtacccataaagtaataacccgtatgtgtcaatgtcaggctaacagcgctttcttttgtttcagatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagacccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaaaaaaaaa

SEQ ID NO: 360925 - DNA, 104 bp, Homo sapiens
aagctgcagctgttcatccaagaggtgaaccacgccgtggagggtgagccgctcggggccctggccgcgggaccctcccctgctctcggctgggcagaggtcac

SEQ ID NO: 360926 - DNA, 3806 bp, Homo sapiens
  misc_feature (3789)..(3789): n is a, c, g, or t
  misc_feature (3798)..(3798): n is a, c, g, or t
cttttatgtaatgacaccattactgcttgtgattattctgatatgatactttatctgtttttttttcctaaatatcacaagctattaaatttatttcacaattgactagtagaccactttgtcaatttggaaaacattcttgttaaagacaaacatatctacatccagaaactttctataccttgctttcaaagagacagcattctttgctagccttccaattttgactcagtgcaaaagccttagaaggatccagtgcataggtcttcatgctttcctttcaccccaagtgattatcaactttgatttttctcttcagcaataactcacttggtgtacccctacctcaggtacagcttttcaactttgcagcaaaactgtactttctagttctttttgtatttcagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360927 - DNA, 1035 bp, Homo sapiens
aggcacttccgcccaggaagacgacgtagcagccatcttttccctggctttggtgattcagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgacagagtcttacacggtgtgctttcatcccccactacctctctaaatatatcttctatactctctttctgtgaattccagccacattgtcctccctcttgcttttcagacctatcaaggatgcttctgcctcacaaccctgtgtgttcttccctctgcctgaaataatcttttacctataatccttctggtcccttcttcattcatttctttgctcagttttagtattataagaaaggcctcggccgggcacggtggcttgcgcctgtaatcccagcacttcgcgaggctgaggtgggcagatcaatcatgaggtcaggagatcgagaccaacctggctaacacggtgaaaccctgtctctac

SEQ ID NO: 360928 - DNA, 1061 bp, Homo sapiens
aggcacttccgcccaggaagacgacgtagcagccatcttttccctggctttggtgattcagaaactcccgttctgtggcgaaattctccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgacagagtcttacacggtgtgctttcatcccccactacctctctaaatatatcttctatactctctttctgtgaattccagccacattgtcctccctcttgcttttcagacctatcaaggatgcttctgcctcacaaccctgtgtgttcttccctctgcctgaaataatcttttacctataatccttctggtcccttcttcattcatttctttgctcagttttagtattataagaaaggcctcggccgggcacggtggcttgcgcctgtaatcccagcacttcgcgaggctgaggtgggcagatcaatcatgaggtcaggagatcgagaccaacctggctaacacggtgaaaccctgtctctac

SEQ ID NO: 360929 - DNA, 3687 bp, Homo sapiens
  misc_feature (3670)..(3670): n is a, c, g, or t
  misc_feature (3679)..(3679): n is a, c, g, or t
caagtcctgtgagcaagataagaatctatagaaccaagatgctcattttcagaagaaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360930 - DNA, 1204 bp, Homo sapiens
aggcacttccgcccaggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagtaaaaaccaaacagttatgagttcttatagttaactgtccatctgctttgcttcttcttagccttgttgccatcacctggtccaaattgccaactgtctttcctggattattgcaacaccctttgtactgcttgccctgctcccacccctctcctcttacattctgttctttaagtggcaaagtgagtttttgttaccttgtgtcagactatgttgttcttctgctcaaaattctctgtgacttattttacatagagtaaaatccacttaatgtggctgacagagtcttacacggtgtgctttcatcccccactacctctctaaatatatcttctatactctctttctgtgaattccagccacattgtcctccctcttgcttttcagacctatcaaggatgcttctgcctcacaaccctgtgtgttcttccctctgcctgaaataatcttttacctataatccttctggtcccttcttcattcatttctttgctcagttttagtattataagaaaggcctcggccgggcacggtggcttgcgcctgtaatcccagcacttcgcgaggctgaggtgggcagatcaatcatgaggtcaggagatcgagaccaacctggctaacacggtgaaaccctgtctctac

SEQ ID NO: 360931 - DNA, 1001 bp, Homo sapiens
aggcacttccgcccaggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtgggtgaggacagcctccctctggaatatctttgtgcccttggagttttaaggctttgtggcccttgaaattgttccctgagtgtgggaatctgactttcctaatttttgtgggatgcagagacactggatgtttctggtctttctgaacagaatattttaggtctttttcatttgtgttttatagaagaactgtaaatgaacagaatactgctatgccttgtctattctttttcatgttttacacctgtcccagtattgaattataaaaccaacttattgaatgtcatcagcagattttaatgaaataaaatagggtagaaaatactagaactccttaggaagaatggcacacactgcagcaaaaactctggccaattgcttgagtgatgtgagaaccaatgggagatttaaggaaaacagacattagttaaaaataggttattcaaacttggttttcataatatgtatttacgcatgtgtgtctgggtcatgaaataaatggtgtttctttactgaagtcacaatttaaataa

SEQ ID NO: 360932 - DNA, 3487 bp, Homo sapiens
  misc_feature (3470)..(3470): n is a, c, g, or t
  misc_feature (3479)..(3479): n is a, c, g, or t
ggaacctttcaaacttccccgaaatgcacttgtggtcagcagctagcggtcttttgtttggggaaaaaaaggagtagcggctaagagcggagccctgacttctcaaaaagcactgcacagaggaggaggcagcagaaccccacgggctgttttgggagagggactgagtacagtgcaacactactcaaactgtggttcacaaagcagcaacattggcatcacccaggtagaaaggctcattcttgagccctaccgaaggccttctgatttagcatttttgcagataggacccagaaatctgcatttcaacaaaatcccaagttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360933 - DNA, 3278 bp, Homo sapiens
  misc_feature (3261)..(3261): n is a, c, g, or t
  misc_feature (3270)..(3270): n is a, c, g, or t
aggcacttccgcccaggaagacgacgtagcagccatcttttccctggctttggtgattcagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360934 - DNA, 3792 bp, Homo sapiens
  misc_feature (3775)..(3775): n is a, c, g, or t
  misc_feature (3784)..(3784): n is a, c, g, or t
aggcacttccgcccaggaagacgacgtagcagccatcttttccctggctttggtgattcagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360935 - DNA, 3961 bp, Homo sapiens
  misc_feature (3944)..(3944): n is a, c, g, or t
  misc_feature (3953)..(3953): n is a, c, g, or t
aggcacttccgcccaggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360936 - DNA, 3790 bp, Homo sapiens
  misc_feature (6)..(6): n is a, c, g, or t
  misc_feature (3773)..(3773): n is a, c, g, or t
  misc_feature (3782)..(3782): n is a, c, g, or t
ttatgnggcggccattttttaaaaatgctttgcagggcaatgcaagtacagccaaatatccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360937 - DNA, 3943 bp, Homo sapiens
  misc_feature (3926)..(3926): n is a, c, g, or t
  misc_feature (3935)..(3935): n is a, c, g, or t
aggcacttccgcccaggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagataccttacttgtaaaagctcttttgctctatgacctggctcaaacttaaacttggatttgaagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360938 - DNA, 3309 bp, Homo sapiens
  misc_feature (3292)..(3292): n is a, c, g, or t
  misc_feature (3301)..(3301): n is a, c, g, or t
ggaacctttcaaacttccccgaaatgcacttgtggtcagcagctagcggtcttttgtttggggaaaaaaaggagtagcggctaagagcggagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360939 - DNA, 3897 bp, Homo sapiens
  misc_feature (3880)..(3880): n is a, c, g, or t
  misc_feature (3889)..(3889): n is a, c, g, or t
aggcacttccgcccaggaagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttagttagaagaaatgttggaagtcatttatatatgaagaaatgttggaaggactcatatatgcatacattccttgagtgactatgaatgactgccgggcagtaacttctgggctgtggttgtaaactgtgagcactacaaaatgtttttccttattgataccatattatggtaggaaagacatggaataaaaaatttagatagtatgtcagtagttgtgtttttaaatgggtttcattagtgcttagcaattgggagcttggtggaccatctcttggttttggaccatctcttggtttctgtcagtatgtaaaccagaaacttcaaatgtgtcacaaaagatgagcagaactatcccgaggttcattaaagtcttttactctgtcctcagtgtgaaatcttaaatctttgaacaaaaaaattcactatctctctgaatcctttgtccttacaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaataaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaagagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtgaagactcgtgtcatttgaattcttccagttatcaagtctcaaagtcagtgtttcagccgtagctcctcatgtcccagtggtccaaagacaacaaaacaatctttatgattagcatagcaagggcttctttagtcagaaccttgacctttataaaatgttacttagaagaggggtgttaagagtgaaatttttctcaggccttttataaaagtatcatggtggacatgccaaaattaagtgtccactagaatgttaactccataaagacagaaactttgttcactactgaatctacataatcttaccattgccatatacttcacaggtgctcaatatttgttaataggtcctttttgaaaattatgttgagatcacctgcagaatatcatgaatttgtaaacaggaaacctgaaagtagccttaataagattaagtcgggagaccattgaaatgtagaaaaccactcaatactgaactccccaatgttaatttggcattgtcttgtgattagatcctgtcctcctttagcctcactaatcaagttgggtcctatcttcccagatgtctagttttctactggttttataccatatagattcaattatcttttgtaacagataattgtgttcatcttgtaataactggacactacatactacacttattttttcaacactgttnaggcagggntttaagtg

SEQ ID NO: 360940 - DNA, 318 bp, Homo sapiens
gcaaaattaatgcagcaacatctcttcttccagcttataaaacaaaatgcaccccatagagttagaatacagaattacaaaagctgcagggattaacaatctctgtctgttgatagattttggatcttctagctacagttaaacaagtctgaggcctaatttctggttttgatcaaatgtagtctcacagtcaaagaggtgaagagtgacttagctccctgccggtcctccctgtcagtgacatcctctggtttcatggccagttcatgggttcccagggccttcacccagctggcttccaggagtgacttcatttta

SEQ ID NO: 360941 - DNA, 540 bp, Homo sapiens
tcagaacagagtcctgtattctacaatggatggattggaagacttgaggatccagtctctttcctttatagataattagactcaggcagaaactcagagctctcagggctttgctgtgctgtgctgtgtcatgccgtcctggggcccggggaaccaccctgagcactttgtggagtgtgtccttgctcaggcttttgccttgggattgaaccgaagctgctcagttccttccacttacctcctctctgtctgatcttccttttcccagagcctcagtgcttgatgctcagtgctcaggagatgtcctttgctccatccttcagaggggcagttgtgtagttatgctgccgggtgagcacagacacacatactttctcccctagctgggaccatcccacacggggtgctcaatatgcatgcctcatgaaagcatagactgtccatttaaaaaaaaatcaggtactcatggtattacaatatgccaggggttggacaaatggattttttacccttttttaaagggttatgtaaaaaaaaaaa

SEQ ID NO: 360942 - DNA, 6511 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgca

SEQ ID NO: 360943 - DNA, 468 bp, Homo sapiens
gcggccgcctactactactactgctcgaattcaagcttctaacgatgtacggggacatgtcttaaggaactcatatacatagtctttctatattatgctaatccttctcaaataaaaataaagacagctaattctcttatgacatgctattgtatctgctggatcattttcattattctctaagacttgtttagcttgatatacccaaggtgtatcaacattaatatcattacagtctatgaaacccttccataactcatgcatttaattcaatatttatatcgaaactgtgacgccagtcactatggggataccttctgtttacctatagtcttgtctgaatacagtaatatatggccacatgtcttcaaaggctatatgaagagcctcctttttttccgtattgacaattgaataacctcccaattccagattctatttccaatttttttcacttacataggttat

SEQ ID NO: 360944 - DNA, 4450 bp, Homo sapiens
gtatctacgatcttaccataacctcccagaaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgca

SEQ ID NO: 360945 - DNA, 7458 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagatcccttctccagtccgagaaatgtggtttgtggtaggaaggaatggtggcctactccatgagcagagcctgtgggggctgaacctgacttcacttacagtgatgatggaggagattggggagctgctacctgtccttctagaagccacggtctggacaaactttctccaggatcacagaagaactgcagcttcctggggagcagtttcacctccacaggcatcgcttcatactcctcactgtcaatgctaaaagagccccctgctccctggggagaagagaatattcagaacagctcaaacacatcagtggcctactggagttggaggtctcacagcagcaccagaagaagttcattatggaaaacaacatcctctcttgaggagctatcctaatgttcttttacaaaaaaaaattcagtgcctactacgatgggcacagtgctggttctggaaacatcctaattctaccatccatgaaaaaggatttattttctttttttggcccctatctcctcccagagtattttgggatttgaacaacatggttataattttcaaatatgtattaaaaggcaagggtcctgccatgtcttaaggaactcatatacatagtctttctatattatgctaatccttctcaaataaaaataaagacagctaattctcttatgacatgctattgtatctgctggatcattttcattattctctaagacttgtttagcttgatatacccaaggtgtatcaacattaatatcattacagtctatgaaacccttccataactcatgcatttaattcaatatttatatcgaaactgtgacgccagtcactatggggataccttctgtttacctatagtcttgtctgaatacagtaatatatggccacatgtcttcaaaggctatatgaagagcctcctttttttccgtattgacaattgaataacctcccaattccagattctatttccaatttttttcacttacataggttat

SEQ ID NO: 360946 - DNA, 7511 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgcaatcccttctccagtccgagaaatgtggtttgtggtaggaaggaatggtggcctactccatgagcagagcctgtgggggctgaacctgacttcacttacagtgatgatggaggagattggggagctgctacctgtccttctagaagccacggtctggacaaactttctccaggatcacagaagaactgcagcttcctggggagcagtttcacctccacaggcatcgcttcatactcctcactgtcaatgctaaaagagccccctgctccctggggagaagagaatattcagaacagctcaaacacatcagtggcctactggagttggaggtctcacagcagcaccagaagaagttcattatggaaaacaacatcctctcttgaggagctatcctaatgttcttttacaaaaaaaaattcagtgcctactacgatgggcacagtgctggttctggaaacatcctaattctaccatccatgaaaaaggatttattttctttttttggcccctatctcctcccagagtattttgggatttgaacaacatggttataattttcaaatatgtattaaaaggcaagggtcctgccatgtcttaaggaactcatatacatagtctttctatattatgctaatccttctcaaataaaaataaagacagctaattctcttatgacatgctattgtatctgctggatcattttcattattctctaagacttgtttagcttgatatacccaaggtgtatcaacattaatatcattacagtctatgaaacccttccataactcatgcatttaattcaatatttatatcgaaactgtgacgccagtcactatggggataccttctgtttacctatagtcttgtctgaatacagtaatatatggccacatgtcttcaaaggctatatgaagagcctcctttttttccgtattgacaattgaataacctcccaattccagattctatttccaatttttttcacttacataggttat

SEQ ID NO: 360947 - DNA, 7403 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagatcccttctccagtccgagaaatgtggtttgtggtaggaaggaatggtggcctactccatgagcagagcctgtgggggctgaacctgacttcacttacagtgatgatggaggagattggggagctgctacctgtccttctagaagccacggtctggacaaactttctccaggatcacagaagaactgcagcttcctggggagcagtttcacctccacaggcatcgcttcatactcctcactgtcaatgctaaaagagccccctgctccctggggagaagagaatattcagaacagctcaaacacatcagtggcctactggagttggaggtctcacagcagcaccagaagaaaaaaaaaaattcagtgcctactacgatgggcacagtgctggttctggaaacatcctaattctaccatccatgaaaaaggatttattttctttttttggcccctatctcctcccagagtattttgggatttgaacaacatggttataattttcaaatatgtattaaaaggcaagggtcctgccatgtcttaaggaactcatatacatagtctttctatattatgctaatccttctcaaataaaaataaagacagctaattctcttatgacatgctattgtatctgctggatcattttcattattctctaagacttgtttagcttgatatacccaaggtgtatcaacattaatatcattacagtctatgaaacccttccataactcatgcatttaattcaatatttatatcgaaactgtgacgccagtcactatggggataccttctgtttacctatagtcttgtctgaatacagtaatatatggccacatgtcttcaaaggctatatgaagagcctcctttttttccgtattgacaattgaataacctcccaattccagattctatttccaatttttttcacttacataggttat

SEQ ID NO: 360948 - DNA, 1276 bp, Homo sapiens
tccctgttccccctaaaatccctgttccccctaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgca

SEQ ID NO: 360949 - DNA, 6176 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcctcttgcctctcaagggttgaggggtcctttctgtcaagtaatggttatttttcgtggtatcctgaggttcagggtgttttaagctgggggtaggaggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtgtcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgca

SEQ ID NO: 360950 - DNA, 723 bp, Homo sapiens
agcggccgcccgggcaggtacgcggtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatgaaaaaaagtgctgca

SEQ ID NO: 360951 - DNA, 1387 bp, Homo sapiens
aaacaacctcacatatgtttctggactgaggttagaactgaaataaaagctaaacaggagccggagctcacaaaatagcagcacctgtggaggagcctagacataggaaaaggtcaccagggcaggaatgcactttcctggaattcctagcacggtcaaagaagagaaatggaagggcctaggcaggctaagcccaccgtgggctctccactgtggttgcactttggaagaaaacagaagaaagtccttttccgtcttgaaccagcctgaggaaagtccgtgtttaggagggccaaccgtcacaccaaaataaaacatgcgctaatggaagccgattgcaaagcaggtgacagagcacactttgggaagcactgctggagtgggggcagaggggtacttgccatgaaaatgccctggggaccctctgacgacactgttgggatggctgaggcacctgttcccttttggtcccaccggtggcctaaagtgtggtctcagagtgcttgtcttctgctgctcactgggtggggcttgtgagcatctgttctctcttcctaggatcacagaagaactgcagcttcctggggagcagtttcacctccacaggcatcgcttcatactcctcactgtcaatgctaaaagagccccctgctccctggggagaagagaatattcagaacagctcaaacacatcagtggcctactggagttggaggtctcacagcagcaccagaagaagttcattatggaaaacaacatcctctcttgaggagctatcctaatgttcttttacaaaaaaaaattcagtgcctactacgatgggcacagtgctggttctggaaacatcctaattctaccatccatgaaaaaggatttattttctttttttggcccctatctcctcccagagtattttgggatttgaacaacatggttataattttcaaatatgtattaaaaggcaagggtcctgccatgtcttaaggaactcatatacatagtctttctatattatgctaatccttctcaaataaaaataaagacagctaattctcttatgacatgctattgtatctgctggatcattttcattattctctaagacttgtttagcttgatatacccaaggtgtatcaacattaatatcattacagtctatgaaacccttccataactcatgcatttaattcaatatttatatcgaaactgtgacgccagtcactatggggataccttctgtttacctatagtcttgtctgaatacagtaatatatggccacatgtcttcaaaggctatatgaagagcctcctttttttccgtattgacaattgaataacctcccaattccagattctatttccaatttttttcacttacataggttat

SEQ ID NO: 360952 - DNA, 2407 bp, Homo sapiens
  misc_feature (595)..(595): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgcaggtgtttatcgatgccaccagttaatgttgttaaataccatctgctctatttgctgccaccttatccatggattctgaaattagataaggtggcatcgata

SEQ ID NO: 360953 - DNA, 357 bp, Homo sapiens
gtagaggtgtcctatgtggcctgtgagtacggggccctcccctcatcttgccctcaggtcccagccctgctcctcccagacacagggctcctgggcgccttgtttcccagtggggtcgggtgggttcccacctctctaaccccgggttccacaggcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggtagtggcagctaaggggagaaccaggggctccaccctcctcagggcagctc

SEQ ID NO: 360954 - DNA, 1624 bp, Homo sapiens
  misc_feature (595)..(595): n is a, c, g, or t
  misc_feature (1592)..(1592): n is a, c, g, or t
  misc_feature (1622)..(1622): n is a, c, g, or t
  misc_feature (1624)..(1624): n is a, c, g, or t
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccncttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcatcatgctccaccctctgagttaaccagctcagatccttgctagattttggaatccagtaaatctganttgacccagaggtgctgctgctaatgtccnan

SEQ ID NO: 360955 - DNA, 1119 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360956 - DNA, 1230 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360957 - DNA, 834 bp, Homo sapiens
gaacatgaccaggacgtttagcagggagtgagccccccacctggtcccagagaagagggagatctgagaagacactgaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360958 - DNA, 1191 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360959 - DNA, 1158 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360960 - DNA, 818 bp, Homo sapiens
gtaggtggtcccttccgcacatttcactctgtacagcaaatggtttcttcccatttgctagacagagggctagattttccccgcccactctcgactcttcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360961 - DNA, 416 bp, Homo sapiens
ggtgggcgctatggccttggtgggcgctatggccttgatgccaccagtcacctgctctgctgtgtgtccgtggttgttggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360962 - DNA, 486 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctgaaagagcagcccaagcatcaaaggataaagagttttgaagatacagttttaaactaagacattagcattatacagaggaaaagagaggatgattgagttttgggtcctttcaagatagcttttttctttgttagaaagcgaaaaaagcccttgattgtcccct

SEQ ID NO: 360963 - DNA, 166 bp, Homo sapiens
gagaggagaacccagccagcaagcccacgccggtgcaggacgtacagggcgacgggcgctggatgtccctggtgagcgttcccacctgggatattgaggagtccgggggcgcggggggtggctcaggagaacggctggttcgtgccactctcactacctgattggg

SEQ ID NO: 360964 - DNA, 762 bp, Homo sapiens
gaacatgaccaggacgtttagcagggagtgagccccccacctggtcccagagaagagggagatctgagaagacactgaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360965 - DNA, 857 bp, Homo sapiens
gtaggtggtcccttccgcacatttcactctgtacagcaaatggtttcttcccatttgctagacagagggctagattttccccgcccactctcgactcttcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360966 - DNA, 1577 bp, Homo sapiens
  misc_feature (1577)..(1577): n is a, c, g, or t
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagaaaaaaacaacacaacaaaataaaaaaaagaacaaaaatggagagaaaaaggggggaaaaagcgatacgacaggaatgtcaacaagatctcacaaccaatatttacaaggggaaaaaggagggacccccaacagggggagcaaacagcaacaacaggacgtactcaaacaacacagcaaacgaaaacacagagaaaacagaaaaagaggacacaaataacaaaccaacgaacgaaaaaatacatagcagcaaacaactacacagactgaacacgactacacgcaagcaagtgagcacagcccgaacacgcaagatgcagcacaagcagcagacagtacagcacgctn

SEQ ID NO: 360967 - DNA, 1080 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360968 - DNA, 507 bp, Homo sapiens
gctaaatgagggctaggatgtgatatttaggaactaccctcccaccctccccacttgcccatccctagtgttttctgcagctggaaacttcatggtggtgggtggaggacaggttggcacagagaacaagatactcaaatgcttgtttccttactacgcctcgtgttcctgctcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcag

SEQ ID NO: 360969 - DNA, 1017 bp, Homo sapiens
gtaggtggtcccttccgcacatttcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaaggtgagcggggcttgggtggggctctaaaacatcttttggctgccccctcaccgctgcttcatgtctctttttccacagattgtggtggtctgggtgggcaccaacaaccacggacacacagcagagcaggtgactggtggcatcaaggccattgtgcaactggtgaatgagcgacagccccaggcccgggttgtggtgctggtgaaaggctgggagagtgggaaaggaagaatggcagtgg

SEQ ID NO: 360970 - DNA, 1062 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacac

SEQ ID NO: 360971 - DNA, 2182 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacacaaaaaaaacaaaaaaaacaaaaaaaaaaaaaaaaaaaaaaaaaaaaaaaacaaaaaaaaaaaaaaataaaaatactaaaaaagacaaaaaataataataataaaataacactaaacatctataacatgtacatttacattgtattccagttctgctctctcttctcactcttcttctactctatcagccacctcccgtctactcctactcatccctactaatctatcaactaaactcaccgcctctttgatatagaacacctctctttcactctacctccctccccgcccgcccctccctcctcactactctgttatgccataactgcacccacatcatctctgtatcatgctccttcttctactaattccaactccctcctctctaaccatgtcactctcatcgtactccatcactacatcctaacatccagtaccacacaacacctccacgcttctaccctatccccccccgccctcctcgccatctccttcactatcccttacttcctctctttttacacgcttccacatacccaccacccactatctctcatccctcccagcgccctgcgcctacaccacctcaagacgagtccattcagctctccctatcctcactctgtaccttcacactacaccatacattcttatctacttcaactactcggcagcatatcccactcactccactcactgccaacgccgccactctaccatcaacctcttaccttagtcattcactctactgtgcccttacgtcactcaccactcacacgcacctcacccacctgacttcctgtacccacgacccggcgagcataacccattaccaatatcttaaccatctcatctttgtagttcttcgtgcgcttcccgctacctattagtccggaagatcatgcaccgtctctattcggttcctatccagtgatctcactcgtgctcccttaatgctagtagctttatctcagtcgatatctcatggtcactctagatctacagtttgctcagtctttcacattcacctctacctcaccactgcattctgctattgcatctgtatgatcccaactgatagactcataactaccgcatatgcattctcatcccacaccctc

SEQ ID NO: 360972 - DNA, 1273 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggattctcctttcttccttccttcctgcccagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacac

SEQ ID NO: 360973 - DNA, 883 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttccttttttttttctgttttgggtgtactctaggggccaggttgggagggggaaggtgagggcttcgggtggtgctataatgtggcactggatcttgagtaataaatttgctgtggtttgtacac

SEQ ID NO: 360974 - DNA, 779 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgtcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacac

SEQ ID NO: 360975 - DNA, 628 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtcatcccggggatgcacgcaggagcttccgggcatcaggggcctgcccctggctggttagcgctttgacagctcgtgggacagccagtccagaccatcgtacagacctgtgccttgggtggcacaggtggcctggacataccacgtgcggctgcgtaagtgctgtagccccagcttgtcagtcagctcgctcacgggcatggcgttgggcatgtc

SEQ ID NO: 360976 - DNA, 253 bp, Homo sapiens
tgttgtggcctctccctttccctggtctctagggggctccctcgctcccatctccatccctgtgcccctttccgttgcagttggcttggatgcggctggcaagaccacaatcctgtacaaactgagtgttctggaagtagtgccgccacagaggccgaatcttgtcctggcctcccacgtcccagactgtgaaacagatgttcttatattccactgtttctacattgaagcctatggttgggatggtggtgac

SEQ ID NO: 360977 - DNA, 1533 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacac

SEQ ID NO: 360978 - DNA, 1431 bp, Homo sapiens
tgttgtggcctctccctttccctggtctctagggggctccctcgctcccatctccatccctgtgcccctttccgttgcagttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttgtacac

SEQ ID NO: 360979 - DNA, 1069 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcaggtggagtgttgggaggggactttctaaccccacgggaaaaggtgttagggctgggagaacagaattgttggcctaggctgggcccccaggccaaggaaaaaacccttccccacttctaccccttctgtttggctatcccctactcactcttcagaactcaccttagtcttccccagcttggacttctctttagaagcaggattctgggaccaggctgcctgatttagccctcataacatgtctttatttccttgcacatctttggataaactacttcctctttgcagtggggtctctagtttgtgccatgactcctgtagagcttctatagagttctgtaaacttctgtagagtttactagatgagaaggattgacacaattacaaatgggaagaaaacagaaagggccacactacggtatgtcccaggcagaagtgattgcttctcctttcttccttccttcctgcccagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacggtaggggtcctgcccacctggtgctga

SEQ ID NO: 360980 - DNA, 402 bp, Homo sapiens
gcgcggaggcggcggcggagcctcctcctgctgctgctgcgccccatccccccgcggccggccagttccagcccgcaccccgcgtcggtgcccgcgcccctccccgggccccgccatgggcctcaccgtgtccgcgctcttttcgcggatcttcgggaagaagcagatgcggattctcatgggtgaggcagatcgagcgcgcggcccggaccggggcgccggccccggcgcagcccttccgcccccgcgtccctccagccccgctcacctgggtctctggccccgagtcacccacctcataacgccccggggcctctgctctcgggcgggtcccggtctgcatcgccgaccccggggcctgacacccggagctgcgggcctgggtggggtgaagctccctcc

SEQ ID NO: 360981 - DNA, 275 bp, Homo sapiens
tgggtgggaagagagtaggcccactggcaggcagtaaccacagaactacatgtatctgggccagttttattccagacatgtggatcttctggtctgcagccttgacaaacttcagagttcccttgtctccttgtacagatgtgtgtaccttttgatcatgaaggcactattaatgtccttcagagtttgtgtcaatttgcaactttgaaggatatccaaattatcaaataatttacatatgatgattattaaattgaagtttctaatttattctt

SEQ ID NO: 360982 - DNA, 400 bp, Homo sapiens
gagctggcaggtgaggaggtggagaggagtgcttcacccagaggagttagagtaaaggtcagaacctcgaggtgagcaacagcaccgggaactgctgggtgcaagcaaaaggtggcaagttgcaggagaagatggtggagaagtcagtgggggctgcatcatggagagctgtgagtgcgtctcctttcagttttgtaggcatttaacaactgcacagagttgtgcaaacacagaactgagtgtgtccccctcacatgaggcctcaggaaaggcattctagaagagaggatgacacatggtttctcctctctaaggttgcagactcagaagtctgataccagtcagttaacgtagatgtgtgagtgggagagtggggtcccaaatattgcatgcttatact

SEQ ID NO: 360983 - DNA, 401 bp, Homo sapiens
cattcgtctattggacgtttgagttatttctactttctaattttgaataatgctgtgaacattcatgtacaatttttcgtgtgaacatgttttcagttctcttcaatatgtacctaaaggccaggcgtggtggctcatgcccgtaatcccagcacgttgggaggccgaggtgggcagatcacctgaggtcaggagttcaagaccagcctggccaacatggcgaaaccctgtctctaataaaaatacaaaaattagccgggtgtggtagcgtgcgtgcctgtaatcccagctacttgggaggctgagacaggagaatggcttgaacctgggaggtggagattgcagtgagccaagattgcaccactgcactccagcctgggtgacagagggagactctgtct

SEQ ID NO: 360984 - DNA, 258 bp, Homo sapiens
tctgttcctctgtgggccagactgccatcccaaatacacatggccagaggccaggcctctcagtccctctcaggtccaagtacagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccgtgagtatcttctgttcct

SEQ ID NO: 360985 - DNA, 1963 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360986 - DNA, 1529 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagtggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360987 - DNA, 1879 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattgaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360988 - DNA, 1501 bp, Homo sapiens
atgtggggcaggcatgaaggtagtacaggagaacccacagaccactatgcagagctgattcctgtgaaaaagaaagagaaagaagttttaggtaccaatgcaattctaagagtttttgcaaggctgatgaggaatcctccaacaagtcacccattagcgttaaagagagcctcagagaactaggcttgctttcacacccttcctgggagcctgtaggaaagaagctttctgtgcaaaggaggtggtgaatttgaaatgcactgacctgggccttctgtcaatcaggtccctgccatggagatctgacagagtgtcattcatgactgccacaacagagacactgaggaaaagatgcaaccatgaaaaggtgcaaaggtgacaagttccaatgacatagaaaatagcaatcagcctttctcacgtctgaaagccttccaaaatacctgagtagcagtagagaattgacagaggactgatcaccaactgagaaacatggtgagagggaaaaaaaactgcaagaatataatcatctcccatcaattttccaacagaaataatgtagtccttgaagaaacaattatacagtatctcatgttacatgcttgttcctgacgctcccccatgtaaaataacatcaccttcattccttcttttcttttctttccatgacagctcctccaggattaggaacttttgctttcaataatccaacgtagcagccgtgatgtcatttttgtatttcaggaagactggcaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360989 - DNA, 1316 bp, Homo sapiens
  misc_feature (368)..(368): n is a, c, g, or t
tgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagctattccctactgaagactggagcgctcagcctgccacggaagactggtctgcagctcccactgctcaggccactggatgagggcatgcctcatccagtggcatnccctcaccagtggcgaggaaagctccacatcgttgacagtcaaagtctctgcttctacaagaataggacttcttcctctccttaatccaacatagcagctgtgatgtcatttctgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360990 - DNA, 1237 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtcgtctaggatcatctacgtcacgacattgcgagataatgacgaataataacgataaggac

SEQ ID NO: 360991 - DNA, 706 bp, Homo sapiens
tctcagcccctccctgcacagagcacatcaaatggaaggggctcctggtcacagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcctgcttcgcgaactctaacccaccggcacagtattcttggacaattaatgggaagtttcagcaatcaggacaaaatctgtttatcccccaaattactacaaagcatagcgggctctatgtttgctctgttcgtaactcagccacctaggacactggcgaggctaggacacctggcgaggctaggacactggcgaggctaggac

SEQ ID NO: 360992 - DNA, 272 bp, Homo sapiens
gaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacaggtgaggagagaacttcctgggagaggacaggaggaggaagcagagtgactggatggggtctcctggagaggctcctggggttctaaaaaataaaaaagccagcatttagggaggct

SEQ ID NO: 360993 - DNA, 1752 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattgctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaagacaaaggcacaaaaacgaaaagccagacagcacgacgggaccagcttgtgcgcagcgccgctgtgcgcgccgcggaagcggcgttttcgcagaaagacacccgacgagagggcgcgcggccgccgcgcaagagtctctggacaaa

SEQ ID NO: 360994 - DNA, 2350 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattggtccctgccatggagatctgacagagtgtcattcatgactgccacaacagagacactgaggaaaagatgcaaccatgaaaaggtgcaaaggtgacaagttccaatgacatagaaaatagcaatcagcctttctcacgtctgaaagccttccaaaatacctgagtagcagtagagaattgacagaggactgatcaccaactgagaaacatggtgagagggaaaaaaaactgcaagaatataatcatctcccatcaattttccaacagaaataatgtagtccttgaagaaacaattatacagtatctcatgttacatgcttgttcctgacgctcccccatgtaaaataacatcaccttcattccttcttttcttttctttccatgacagctcctccaggattaggaacttttgctttcaataatccaacgtagcagccgtgatgtcatttttgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360995 - DNA, 2279 bp, Homo sapiens
ttttttgcaggaggaaggacagcacagctgacagccgtgctctggaagcttctggatcctaggctcatctccacagaggagaacatgcacgcagcagagatcatggggcccctctcagcccctccctgcacagagcacatcaaatggaaggggctcctgctcacagcattacttttaaacttctggaacttgcctaccactgcccaagtcatgattgaagcccagccacccaaagtgtccgaggggaaggatgttcttctacttgtccacaatttgccccagaatcttactggctacatctggtacaaagggcaaatcagggacctctaccattacattacatcatacatagtagacggtcaaataattatatatggaccggcatacagtggacgagaaacagtatattccaatgcatccctgctgatccagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggagactgtgatcttaacctgtaatcctgagactccggacgcaagctacctgtggtggatgaatggtcagagcctccctatgactcataggatgcagctgtctgaaaccaacaggaccctctttctatttggtgtcacaaagtatactgcaggaccctatgaatgtgaaatatggaactcagggagtgccagccgcagtgacccagtcaccctgaatctcctccatggtccagacctccccagaattttcccttcagtcacctcttactattcaggagagaacctcgacttgtcctgcttcgcaaactctaacccaccagcacagtattcttggacaattaatgggaagtttcagctatcaggacaaaagctctttatccctcaaattactccaaagcataatgggctctatgcttgctctgctcgtaactcagccactggcgaggaaagctccacatccttgacaatcagagtcattggtccctgccatggagatctgacagagtgtcattcatgactgccacaacagagacactgaggaaaagatgcaaccatgaaaaggtgcaaaggtgacaagttccaatgacatagaaaatagcaatcagcctttctcacgtctgaaagccttccaaaatacctgagtagcagtagagaattgacagaggactgatcaccaactgagaaacatggtgagagggaaaaaaaactgcaagaatataatcatctcccatcaattttccaacagaaataatgtagtccttgaagaaacaattatacagtatctcatgttacatgcttgttcctgacgctcccccatgtaaaataacatcaccttcattccttcttttcttttctttccatgacagctcctccaggattaggaacttttgctttcaataatccaacgtagcagccgtgatgtcatttttgtatttcaggaagactggcaggtatgatgaccttttctcttatcctggttcctgcagggctgactgccatgcttgggagagggaaatgacttatttgcctgtatctgggcctggatctcctccttcatccactaactcctgcttctcagcactaattcctgcagttccctttctccctggcctttatgctccctgtaccccactgtcttttagacataattatctccagcctctgctcatttgtttctcagattcaaatgagaaacacaatttcacatggtgaaaccctcttcattatttttaacatctctcaatagtgtaattctctccattcccataaagctcaaccacttctcaaagtattgcttgacttcttgtctccagactttgaaatcttccttgcatatgattgcctcattacctttctaaaatctggttaattgatttaatcaagaatctgcaggggtctactctagcctatttgataagttcacatttcttctatttactaaggcttctcacttcctttacctctacttcctagtataaatcctccatcctaattagaactgtcttcctacacatccctgccccttcacccatatagacataaaattcttagttccaatgctatgtctaaaaacagagtgaaatcccttccaccatctgcactgcagacttaaccacacccttcatcacaagcaacatctgacctcgtggagaacaaagactttaggattaacatgtgaacctgagactcagg

SEQ ID NO: 360996 - DNA, 1592 bp, Homo sapiens
tctcagcccctccctgcacagagcacatcaaatggaaggggctcctggtcacagaatgtcacccgggaggacgcaggatcctacaccttacacatcataaagcgaggtgatgggactagaggagtaactggatatttcaccttcaccttatacctggagactcccaagccctccatctccagcagcaacttaaaccccagggaggccatggaaactgtgatcttaacctgtgatcctgagactccggacacaagctaccagtggtggatgaatggtcagagcctccctatgactcataggtttcagctgtccgaaaccaacaggaccctctttctatttggtgtcacaaagtatactgcaggaccctatgaatgtgaaatacggaactcagggagtgccagccgcagtgacccagtcaccctgaatctcctccatggtccagacctccccagaattcacccttcatacaccaattaccgttcaggagataacctctacttgtcctgcttcgcgaactctaacccaccggcacagtattcttggacaattaatgggaagtttcagcaatcaggacaaaatctgtttatcccccaaattactacaaagcatagcgggctctatgtttgctctgttcgtaactcagccactcaccagtggcgaggaaagctccacatcgttgacagtcaaagtctctgcttctacaagaataggacttcttcctctccttaatccaacatagcagctgtgatgtcatttctgtatttcaggaagactggcagaaagttgctttgattcttcctcaaagtatttaaaatcagctacagtccaaaattgctttttcttcaaggagatttatggaaaagactatgaaaaggactcttgaatacaagttcctgataacttcaagatcataccactggactaagaactttcaaaattttaatgaacaggctgataccttcatgaaattcaagacaaagaagaaaagaactccatttcattggactaaataacaaaaggataatgttttcataattttttattggaaaatgtgctgattttttgaatgttttattctccagatttatgaatttttttcttcagcaattggtaaagtatacttttgtaaacaaaaattgaaacatttgcttttgctctctgagtgccccagaattgggaatctattcatgaatattcatatgtttatggtaataaagttatttgcacaagtttaaaaaagcaaacaacacggaacaccaccacaaacaacattgtggggcgacctttgcgagacaccgacaggagaaggtttctctaaacacattggctttggggcgcgcgggcccccaaagggcaacagggacacctgtcgtaccaaagcgcgggttcccaagagagaaaacggggcacaggagaacaaggaggggggagaatatcctcagcacgaattaaaaaaaaaaggccggcgggcgggacaaccgaagccgttgttgaaacaaatcaccacaaaggggcgatccgggagaggagcaaagagggggatgcaaccacagagggaggtcaccaggaaacacccaatataaatatagccc

SEQ ID NO: 360997 - DNA, 643 bp, Homo sapiens
tctgttcctctgtgggccagactgccatcccaaatacacatggccagaggccaggcctctcagtccctctcaggtccaagtacagagacctttacccctaggcatcaaagctggccatgactttctgccccaggcaaaccagaataggcctaggcttgatccacaataggagaaaagaggctcctcctgtcataggagactcagggtccacagcttgtgactttatgctctttgctccagatggcctggatgcccccaccatttcttcctcacacctattaccatacaagggaagtccccaagctctcctgcctcacagacactcacccactggcagagcattcttggctgattgatgggaagttccagcaatcagcacaagtgttctttatccctcaaatcactaaaacatatagagggctctatgtctgtttcatccataactcagccactgctggaacaaatctcataatcaagaggaccatagtccctggtaagtggatccctgaaacattggcaatatgttttccagtgaagtctatctagctatcagggaggggagacactggaggagagagcccgcctcaatgtgatgcctgcagattgatgtgcagaggcgtaggaggaggaggtataggagtat

SEQ ID NO: 360998 - DNA, 1217 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggtcccaaattcgccctatagggagccgttttacaatccatgggccggcgtttaacaacgtgggaactggaaaaaccttggggttaccaaactaaatgcctggaagaaaatccccctttggcaattggcgtaaaaccaaaaggcccaaccgatggccttcccaacattgccaacctaattggcaattgcaaattgaagcgtaatatttggtaaaatccggtaaattttggaatcagttaattttaaccaaaagccaaatggcaaatcctttaaataaaaaatccccggatgggtgagtgtgtcaattggaa

SEQ ID NO: 360999 - DNA, 987 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaagacatggaggacttgaccccgtgcctctccctgaaattaaagaacagttgacagaaaaaagagacagaaaaagaaaagaaagcggcaaacagaacgagcacacgcacaagaagaacagaacacgaggaggaagaagtgagcgacccagagaacgccaagccgcaacgaggccaaagaagagcgaggcggagcagacggagagaagcggagcaaagaagagcgaggggcaacgagaggcaggagagcggcggggcaaagaaggaaagaggagaggaagacgaagcggagacgggcgcaaggcgggagaaaacgaggggcagagaggggagcgagcgacggacaagaggagagcgt

SEQ ID NO: 361000 - DNA, 809 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcatatacttctcctctccttcttttttttttttttcttttttttttttct

SEQ ID NO: 361001 - DNA, 1346 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggtcccaaattcgccctatagggagccgttttacaatccatgggccggcgtttaacaacgtgggaactggaaaaaccttggggttaccaaactaaatgcctggaagaaaatccccctttggcaattggcgtaaaaccaaaaggcccaaccgatggccttcccaacattgccaacctaattggcaattgcaaattgaagcgtaatatttggtaaaatccggtaaattttggaatcagttaattttaaccaaaagccaaatggcaaatcctttaaataaaaaatccccggatgggtgagtgtgtcaattggaa

SEQ ID NO: 361002 - DNA, 668 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcatattcggctcatctcctagccagatcccg

SEQ ID NO: 361003 - DNA, 1428 bp, Homo sapiens
gagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggtcccaaattcgccctatagggagccgttttacaatccatgggccggcgtttaacaacgtgggaactggaaaaaccttggggttaccaaactaaatgcctggaagaaaatccccctttggcaattggcgtaaaaccaaaaggcccaaccgatggccttcccaacattgccaacctaattggcaattgcaaattgaagcgtaatatttggtaaaatccggtaaattttggaatcagttaattttaaccaaaagccaaatggcaaatcctttaaataaaaaatccccggatgggtgagtgtgtcaattggaa

SEQ ID NO: 361004 - DNA, 855 bp, Homo sapiens
gaggcaatcagcgccaaaagacgaccgtggtgagcttgagtctagcctggcacattacacgagacactgagagagatgcagtgactgagtacacacgtgctcgaagtctgattcagtaggccatagcatgcacgctgaattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggtcccaaattcgccctatagggagccgttttacaatccatgggccggcgtttaacaacgtgggaactggaaaaaccttggggttaccaaactaaatgcctggaagaaaatccccctttggcaattggcgtaaaaccaaaaggcccaaccgatggccttcccaacattgccaacctaattggcaattgcaaattgaagcgtaatatttggtaaaatccggtaaattttggaatcagttaattttaaccaaaagccaaatggcaaatcctttaaataaaaaatccccggatgggtgagtgtgtcaattggaa

SEQ ID NO: 361005 - DNA, 1023 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagaacatttatcggttgtgatacgtggtaaacagcagaggtttaacaaattcgggacatgcacattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacattttcatacagtcctggcaggtacacaacctgctacgccagttcaggggccataaggtggcagtgtctttctttataagctgcttagctttaagctcctgaagagtaccgagctcg

SEQ ID NO: 361006 - DNA, 4152 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccaggtaatgtgtgaagtacgagccatcaagaaataagactgggccaggcgcggtggctcatgcccataatcccagcactttgggaggctgaggtggcggatcacctgaggtcacgggtttgagaccagccttggcaacatggttaaacctcatctctactaaaattacaaaaactagccaggcatggtggcacatgcctgtaatcccagctactcaggaggctgaggcaggagaattgcttgaacccaggaggcggaggttacagtgatccgagatcatgccactgcactctagcctgggcaacagaatgagattccgtctcaaaaaaaaaaaagaaaactgaagtggaattaattctgtaaacttatggctttggatttcaattttatcctttgcctaaagaaatctctttacaaaatctaaactatgaaaactatggtagtttaaaaaacatgcttcaaaacttaattttatttcagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361007 - DNA, 2388 bp, Homo sapiens
gttatcattaacataattcttaacagtatcatttgacttgtttgtgaatgctatgacctcggattgcgattctgttacttagttctctttcataatctttgcttttcaaaaacaggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361008 - DNA, 2331 bp, Homo sapiens
  misc_feature (56)..(56): n is a, c, g, or t
gccaccgacgacccgcccccaacccacgcccacacctggacgccgccaccacctcnaggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361009 - DNA, 1147 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacattttcatacagtcctggcaggtacacaacctgctacgccagttcaggggccataaggtggcagtgtctttctttataagctgcttagctttaagctcctgaagagtaccgagctcg

SEQ ID NO: 361010 - DNA, 198 bp, Homo sapiens
agataaaggttatattttacattataattagtcttctaaaaataaattctaatgatatgatcagtgtattattacagtatttataaaataatgggcattttggacaatttggcaatcacaagaaaatttttggtgttctatattcacagcatcttggtgccattccccctgagagtggggattttcaggagatggtat

SEQ ID NO: 361011 - DNA, 3676 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361012 - DNA, 3649 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361013 - DNA, 3619 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctggcattgtatgtgcatttttgtagaaattgttactggacttataattacatacttaactctgatcaggtttctgtaaaatttaaataaaaccaatacaaaata

SEQ ID NO: 361014 - DNA, 3598 bp, Homo sapiens
agcgccacccggaggcggaaatcagcccgcgtcggcgcaggcgggagaagggagaggagtgacatccgtttgtcggaagtcgctcctcccccttccttcgctttttttccttgtcattggttcctggcactcgggccccacctcctccggctacgcccctcacggccgcttttcccgcctccgccggggccgagccgctgttcggctgacagttgaggatggccggagccgagggcgccgctgggcggcagtcggagctggagcccgtggtatcgttggtcgacgtccttgaggaggacgaggagctggagaatgaggcgtgcgctgtcctgggcggcagcgactccgagaagtgctcctactctcagggctcagtaaagagacaagcactatatgcctgtagtacctgcaccccagagggagaagaaccagcaggaatttgtttagcttgcagttatgaatgtcatggaagtcacaaactatttgagctatacacaaaaagaaattttcgttgtgattgtggaaacagcaagtttaaaaatttggaatgcaaattacttcctgacaaagcaaaggtaaattctggcaataagtacaatgacaacttttttggattgtactgcatttgcaagagaccttatcctgatcctgaagacgagattccagatgagatgatccagtgcgtagtctgtgaagactggttccatggaaggcatcttggtgccattccccctgagagtggggattttcaggagatggtatgccaggcctgcatgaaacgttgttcttttttgtgggcttatgctgcacaattggcagtaaccaaaatatccactgaggatgatggattggtgcggaacattgatggaataggtgatcaggaagttatcaaacctgaaaatggagagcatcaagatagtaccctcaaagaggatgttccagaacagggaaaggatgatgtccgggaggttaaagtagagcagaacagtgaaccatgtgccggctctagttctgaatctgatctccagacagtgtttaagaatgaaagcctcaacgcagaatcaaaatctggctgcaaacttcaggagcttaaagctaagcagcttataaagaaagacactgccacctattggcccctgaactggcgtagcaagttgtgtacctgccaagactgtatgaaaatgtatggagatctagatgtcttattcctgacagatgaatacgacacagttctggcttatgaaaacaaagggaagattgcccaggccactgacaggagcgatcccctaatggatacccttagcagcatgaatagagtccagcaagtggaactcatttgtgaatacaatgatttgaagactgaacttaaagactatctcaagagatttgctgatgaaggcacggttgttaagagagaggacattcagcagttctttgaagagtttcagtcaaaaaagagaagaagagtggatgggatgcagtattactgcagctagagtggagtatgaagctttctcattcaagccaatgaaaatgcgcttcccattcttggaataaaagaggtgtggttcacatttggccccctttccgtcctcctctgtttggagaggcctcgcgctcccttcattctctttagctgcagtagccaccgtgtggatgctgacttcacagccagcgtcctctgtgactcagctgatgcagctcattccacagacttcgccagtgtactcctactccagtgcacccagggttatttgcatagtttttaagtttgattttgttttgagaaagcaaattggtgtcttgtttaatgatctgttatttcactcccagatgtgtgtgttttgccacagagctgttgccttccagaacctcctccgcaggcatcacggaaggctctcttcccgtcacctagaacctctacaggtcccctcgcccctatgatcgtggtgccttgggtcaaagcttcctcaagcctggtctgctccttctttcacgtccctgttttctgaggtttggtcatagcttagaaaggatcttggggcttgttttctctaggcccaacctccagagtagccaggactgatggttttctggtctggatgtctgtcacaggcggagagattaacagatgacagggttgaggaagcaagcctttgttatgaattttactaatacagttcaagtgaaattttcgttcatgattctattggcactagaattagaatttcagtactgtagtgctcacagggcttcctggagaacatttgcccgtatactagtcccttctctgctgcctagaaaacagaccgggtctcacccctgtgaaatcttggtggtttacgaagtcctctggatttcttgatattatcagggatattcataagcatatatcaaaaatggacctattttgatattctgttatgaaaatgttattagaaccccaataaattattatttttcccccttgaatctgctaaagaaaacagatcctgacttagcttacttgaaataagcagggcagggagccctgttttggaagagacagactgtggaagagattacaaacaaggcccgaggctgcacgaatgatgagttttgtgtatataatgttaatgtccaccgccacttccctaacgactatgagatcttttttttgaagatcctcatggaaggttgtacagagccccacatttgaggggaagtcctttcagttgatatgagatctctttaacacccctcagtctatgtaggaaatgccttgtgatacatagagaaccctcagcttctctctgcctctggaggaccaaggtctttcctgacagtcggagacacaccttgatgtatgttaataaaagcatttcaggctgtggggccaccatgtatattaatactccttatgtgtccagcatctgtgtattcattcgagtgcccaatccctggatgagatgaactaggccttataaaaagtcaaagcctcaaagaaatggcacaaccatgttcttcggcactcaggctcctaattgcagatcctcacgaagggtggtatgtggagctggaaggtcttgtggccacaggacatgctggtgagccctgagctggccttgtgcagagggctccgttcaaaggctcggggtgtctttgaggttgtttatcaagctggggaactcttccaagtctgacaatgtttcgaaccctttttgcaaggttgcactattagtataccatcatgtccggaaaacttttaatcttctcaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacctgttgttcacaactagttttcttattgactgtattggactgtctcttcttgtagagactgattttggccaacatattaatgcatgttttatgcaaaacacaaatatgatattagttgcttttaaggagttctgacggaaggagtgctgacgcagcgg

SEQ ID NO: 361015 - DNA, 419 bp, Homo sapiens
agccacatctgccccctcagtcccaccacactggaattcacacaatcaggacccagagttaagagtccaaccctagatcctcctgtccaaccacccccgcaagcagcattagaaaagcacctcttggggccgggcacggtggctcatgcctataatctcagcactttgggaggccaaggcgggtggatcacctgaggtcaggagttggagaccagcctggccaatatggtgaaacctcgtctctactaaaaatacaaaaattagccaggcatggtggtgcgtgcctgtagtcccagctacccgggaggctgaggcaggagaatcgcttgaactcaggaagccgagattgcagtgagctgagaccgcatcacggcactccagcctgggcgacagagtgagactctgtctctaaataaata

SEQ ID NO: 361016 - DNA, 356 bp, Homo sapiens
gtggactgctggctttcccagtacctgccaggagggaggcacaagggtgaatcatggactattgaggcgccctgcaaagcgttgcactgctggctgcaggcagcctcactttgggcaagtccccccccatgagctggggagactcagtcatggggagggaggagagggcaagcccccaagggcctctgaacctggcaggtgctgcacggggctggcagttgcttgtggagctgacgtgagggcccgttctcagcagatggcagctggccctgcaacagcagctgcagatgtctttgagtcagtcgtgcggtgctcctggggcttcacccgacccaactttcccagcccaaggcaca

SEQ ID NO: 361017 - DNA, 497 bp, Homo sapiens
agggtgcaagagccacatttacaaacaacaaacttgatctttaaaaatgtttttaaaactctctgagtctcagtgacttcatttgtaaatgagagtgattcatctagatgactctaaggtctctttcaggtcccaggggacgtgatctaagttaggagtgggaacatgggagtggctgcttctccttggctaagcccatgcagactattgtgcccaggactggaataaaggtcctttttgctgcatcacccaggcaacactcccagccttactcaggagtggtgaacattttctgctctggacatagaataggtaggttcattcctggtcttttcactttagattctctttaggttcaagatgcagatttctcaatttggacacacctgcatcacgttggtcaaattttgctgcctgtttctagggttttcttctcagtttcatccctgccttcccttttttgttgttttttttttggttcaaggcccagcttcagt

SEQ ID NO: 361018 - DNA, 463 bp, Homo sapiens
gaaaggaagagactgggcccccgataattttgtggagaagagctatcacactagccaggacttttatgtaagagttaaaaatttcatcttgtttaagccacttttaatttgatttcactgcaaaagcagctaaccaatatactaacacatgtagcaggtataaattatgttagaaattacagtaaaagtaaatggagtagactatttaaaagacagtgattttcaggctagaataaaacaaaaacaaaacaaaataaacacagacatgctcatttgttatatattgtctatagctgcattcacaccttactaccagagttgaatagttacaacagagactgtaaaacgtcaaaaatatttactatcggccgggcatggtggctcatgcctgtaatctcagcactttgggaggctgaggtgggtggatcgcaaggtcaggagtttgagaccagcctggtcagta

SEQ ID NO: 361019 - DNA, 924 bp, Homo sapiens
atcagaagggtaggagaaaagtcagctactgcagagtgatccaactacttacaattttagtaagagtgtatcttttaaataacatattttatttatctgtatactctcattcaggaaaactgttctctctgtcatataatggtttttgaaaagaatgttccctgaatgcacatgtaaataatttctttgctaaaaccagcatttctgataattccacagaactgatagtgagaaaaccttgagtactggaaggttttgtggtgcagcatatttaataactgtgacaactcaagaattttaagcagactcgcctccttgtctgggatctgtcggcagtattgtgtctctactggcaagcccctcaatgtactgtttcagccaaaaccgtgctaatgatggtctaccaaatttttacttggtattttaaagtctcaatattctcaggatttagaaaatactttccctcatcctttcaaaagctgccactctgaaatacataggattttttttaaaaaagtctaaaattgctttacagccttgataaaacaaagactggtgtgttgatgtggctgcttttgtatgatttccgaggtgaatttagatgactggaagatagatgggtgccagatgcagtttgacatagattcaggcagctgctcctgggctaggtttcattagctggtaagtgctccagcagaagcagcagagcgaggccccaaatgccaaaatgacagtgagaacagtggaacaatacaatattcaccaagtgattttaatctcgaagattaaatgtcacccaatcagtttccaggtcttaaaaaaccaacttgcatgaaaccattagaaggcccaagtctttgttcaccagaagaaacaagttttactgtttttgaagggggagggtggttagttttaaaacaccaa

SEQ ID NO: 361020 - DNA, 256 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcctttcaattcaaacgtgttattatgcttacaaaagggttatttaagcatg

SEQ ID NO: 361021 - DNA, 2456 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaata

SEQ ID NO: 361022 - DNA, 732 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactcttggtatctaaactgctttaaagatacttgggtgttttttttaagccttaaaaaatggaaagcttcttcctt

SEQ ID NO: 361023 - DNA, 712 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactcttcactatttttgttgtttgcttctatgtatatactacataagtatattaaa

SEQ ID NO: 361024 - DNA, 2700 bp, Homo sapiens
  misc_feature (2177)..(2177): n is a, c, g, or t
  misc_feature (2180)..(2180): n is a, c, g, or t
  misc_feature (2184)..(2184): n is a, c, g, or t
  misc_feature (2187)..(2187): n is a, c, g, or t
  misc_feature (2195)..(2195): n is a, c, g, or t
  misc_feature (2203)..(2205): n is a, c, g, or t
  misc_feature (2209)..(2209): n is a, c, g, or t
  misc_feature (2211)..(2211): n is a, c, g, or t
  misc_feature (2213)..(2213): n is a, c, g, or t
  misc_feature (2216)..(2216): n is a, c, g, or t
  misc_feature (2219)..(2219): n is a, c, g, or t
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagcanaanaaanaanaaaaaaanaaaaaaannnaaanananaanaanaaaaaaaaaaaaaggggggggggcgccaacaaatgaatccccgaggggggacccacacatattgagcgggcgacacacaagtatttgttgagcaccaagggggggcaccacaataggaggggacgctatataaacacacgagagcagcagagcgcaggtgtattacaaaaagcgctgcacgacggcgcaacaaaacgcgtcaccaccgggcacacccccgtggagaagacggcccacccaacacctgggggggggggagcggaacacaatagtggggggaacagaactactactcacacaacaggaatatataagaagccctcagtggaggagaacatttcaaagacaattcagagcggctgctaaaagtgatgctgaaaaaaagcaagaaacataattatgacgtgcgagtagtaaaaaaaattagctaacacgaagcgagaattattagttgtggaagaaactatatttaccccgaggg

SEQ ID NO: 361025 - DNA, 2652 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361026 - DNA, 2127 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361027 - DNA, 2254 bp, Homo sapiens
acaaggaaagaaaacctatagtggtctatgtctgtcgatgatatctattcagctaacacatgagcattctgccaggcagcacagaaccctaacctacagagagctgcagagaaacaccacggagaggtggaggaggaggatgaagcacttcttaaacagaggtcgactaaccagcaaattcttctttcttcctttttttttcttaaagggatctatattctagcttctaaaaacttgagtctgaacagaaataaaaagaaagagtcgatgctaacatacaaaacactcagcatctctctttatcattttttaaaaggcatgcaattttgacaaatgatacatttctaaaagctttcttctctattcaagatattaatgtccattctgaatgaaagatgcctacatactgcctgcaatcagtttctagcaacagacaccctatgaagcccctagcagggaaggtggggggaagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361028 - DNA, 1875 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361029 - DNA, 1910 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctgttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361030 - DNA, 1776 bp, Homo sapiens
gggggtgtgtggggtagttgtattatgttgcttattctctgccgcatcagtatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361031 - DNA, 2340 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361032 - DNA, 2285 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361033 - DNA, 874 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttggaggaagcggagggattgatcttgctgtctcatggggtgtgcttcaca

SEQ ID NO: 361034 - DNA, 1197 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaagaactacctttgtttggagcttcacctcttgcatgtgacacaaccctgatctctgcttgtgctctgcctggtacacatgcccttgttcttaaaaagaagtccatctctagggggtgtgctaatttgctttgatggttgctgttacagctcattactccgcaattgtattacttcagtgtgtttttcttaatctgttaccatgaatatatttactatttgatggaacagttgagagacttttactgcaagtgtcagaaaacccagcccacactggactaagaaaaaagggaatttgttgtgtcacatagtagaaaaagtccagcattaattgaaggtatcctttgacttaggggcttaaaatgccaccagaaccctgtttcccaactctttcttcatttttaggctccctctggtgacaagatgactgtcaaagtcttcagctctgtatcctcccagattctagtcagcctcaaagacagactgtttga

SEQ ID NO: 361035 - DNA, 1022 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgagaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaata

SEQ ID NO: 361036 - DNA, 288 bp, Homo sapiens
catgatctccagagaagcagccgaccagctcttgattgtggctgaggggagctacctcatccgggagagccagcggcagccagggacctacactttggctttaaggttggtcatgggcctgcaattactactgtgctttatttaaaactctcttaatatagggctttaaattttaaaagcattcagcatgtaattgaattggttcttgttttcttgggatctaattaccattttaatagctttgagaccctttaaaaattcctcgtgaatggtaacactcagtaatta

SEQ ID NO: 361037 - DNA, 2265 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361038 - DNA, 2260 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagagaaaaattagacaataaaagaccgaaagcgcgccggcagacgaattgaaccataataacatgttgtgaatattattgaaaaaaaa

SEQ ID NO: 361039 - DNA, 2527 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaaggttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361040 - DNA, 2069 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaata

SEQ ID NO: 361041 - DNA, 2207 bp, Homo sapiens
gggcttcatagggtgtctgtgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagacatcctcctcctccacctctccgtggtgtttctctgcagctctctgtaggttagggttctgtgctgcctggcagaatgctcatgtgttagctgaatagatatcatcgacagacatagaccactataggttttctttccttgtgaattccaaaatgccatccaaagagtcttggtcagggaggaaaactaatagggctgcagttcacaaatcaaaacaagagggccgtcagcaagatttattgatagcagccttgggaatgaaactgggttctccaaagtcgtctgtgacaatctggcaacctctgaaactctttgcttattcgcagttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361042 - DNA, 2129 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcagatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaaggtgtcatccaacaggacagggttgatgacctgttcaacagcttgaaacgttgattccctgtcacaatggatgacatttttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361043 - DNA, 1669 bp, Homo sapiens
ccctgttaatgaattgaccatgatgaaaggaggatggctaccatgggactgttgatgctgctgacactagcagcttctcctcactttttgagtatttgctttcaccatgtatgcgtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaattatggatccggatgagcaattggaaacccttcatgaagcactgaaactactgccacctgctcactgcgaaaccctccggtacctcatggcacatctaaagagagtgaccctccacgaaaaggagaatcttatgaatgcagagaaccttggaatcgtctttggacccacccttatgagatctccagaactagacgccatggctgcattgaatgatatacggtatcagagactggtggtggagctgcttatcaaaaacgaagacattttattttaaatttttaatttgaggggaaaagaaatgttttacagatgaaggaatgttttatagtaatttaatttgctcctgtagctgcattatttcttgattagaggtttgggcatataaccagattaaagtgaaggaactttctgttgtttttgtagcaccgctcagctgtcttgtaaaacagtgaacacacgctttctggttctagtaatcctgggtgtttatcacgttcagagaaactcaagctattgcatgattagccccctatctggcaaggaaaccccatacagaagaaacaacaaacctgcgcctgcaccgcctctgcgtcctgggtagtctgtgcttgtaatccagcatgtttcacagagtaagcctgttgtgactttgcttttggggtctatgtcattggtttctgatgcttgtacaaacacgcacacacaaatggataaaacagcacctctggctgttacattaccataaaccatatcacatgcctacattttacaaatgatttctggtttctcttagttcttctctaacatagtactttctttccagcaaaagcaaaatgtgttttcagatttgttactttaataaaggttatccataccaataaaaagtgtacaacacagcattttctgttaaattattattggttttcagttgtaatttggtattttttctggcatgcgtttattaatttattaaattggcttttagaaataaaaaatattgatagcttacttttttctcataagaatattcgggaaaatgtgtttggccatttattaaatactgagtacttcttctg

SEQ ID NO: 361044 - DNA, 1917 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgtcatccaacaggacagggttgatgacctgttcaacagcttgaaacgttgattccctgtcacaatggatgacatttttgacatcacttgttagaagagcaactctgaaagaaaacgagcaaattccaaaatatgaaaagattcacaatttcaaggtgcatacattcagagggccacactggtgtgaatactgtgccaactttatgtggggtctcattgctcagggagtgaaatgtgcagattgtggtttgaatgttcataagcagtgttccaagatggtcccaaatgactgtaagccagacttgaagcatgtcaaaaaggtgtacagctgtgaccttacgacgctcgtgaaagcacataccactaagcggccaatggtggtagacatgtgcatcagggagattgagtctagaggtcttaattctgaaggactataccgagtatcaggatttagtgacctaattgaagatgtcaagatggctttcgacagagatggtgagaaggcagatatttctgtgaacatgtatgaagatatcaacattatcactggtgcacttaaactgtacttcagggatttgccaattccactcattacatatgatgcctaccctaagtttatagaatctgccaaaaagtatggatcggatggagcattgaacccttatgaagatgaaactatggcactggttatgaaacctcggtactcaggacattaagaacggcctccagaaaggaatcttgatggagactggaatgtggacacctataatcaaaaactgggtgagcatcggcaaacacgcggggccttcaaggacgttcaacggggcaaataacagtcacatcaggctatcaagcgcaacaaattcgacaaagttatacgtctactccctcttctct

SEQ ID NO: 361045 - DNA, 1398 bp, Homo sapiens
cgtgggagacgctatcgcaagatggcgtctgcgaggccgcgggatgcggagtgagcgcgccccgccgggggctgtgcgaggctgctgctgctctccccgtcgccgccgccgccgccgccagtgcggcgccgcctctccgccagccactgcgccgcggccaagcctcctgcctcgcaggtacctcctcccgcgcgcacgctccgcgcctgatggcagcgacaagtgccggctcgcggagagctagcggggctccctgggcccggtgcgcccgacaataacgcgtgaataactttttcttgcagcggtcccccgcgtcccggcctgcagcctccccgggcgccggcgcccccagcacgccccatcgggcaccccactctctccgaggtgtgggtgcggcgggctgatgaggtgatccctagcccgcctgggaggagcgcctggactcgcgggcggcggcgagcgcctttacaatggccctgaccctgtttgatacagatgaatatagacctcctgtttggaaatcttacttatatcagctacaacaggaagcccctcatcctcgaagaattacctgtacttgcgaggtggaaaacagaccaaagtattatggaagagagtttcatggcatgatctccagagaagcagccgaccagctcttgattgtggctgaggggagctacctcatccgggagagccagcggcagccagggacctacactttggctttaagatttggaagtcaaaccagaaacttcaggctctactacgatggcaagcactttgttggggagaaacgctttgagtccatccacgatctggtgactgatggcttgattactctctatattgaaaccaaggcagcagaatacattgccaagatgacgataaacccaatttatgagcacgtaggatacacaaccttaaacagagagccagcatacaaaaaacatatgccagtcctgaaagagacacatgatgagagagattctacaggccaggatggggtgtcagagaaaagggtgtcatccaacaggacagggttgatgacctgttcaacagcttgaaacgttgattccctgtcacaatggatgacatttttgacatcacttgttagaagagcaactctgaaagaaaacgagcaaattccaaaatatgaaaagattcacaatttcaagaactacctttgtttggagcttcacctcttgcatgtgacacaaccctgatctctgcttgtgctctgcctggtacacatgcccttgttcttaaaaagaagtccatctctagggggtgtgctaatttgctttgatggttgctgttacagctcattactccgcaattgtattacttcagtgtgtttttcttaatctgttaccatgaatatatttactatttgatgga

SEQ ID NO: 361046 - DNA, 352 bp, Homo sapiens
agctcattctaggggaaaccagctgccatattaagaaaacagtcctatggaaagggccatggaacaaagaagtgacttctgccaacaacctcatgagtgaacctagaagtggctcatctagtcctggtcaaatcttatggactgtggctccaactgatagtgtgactgtaacttcataagagacgctgaaccagaccacccaataagacactcccagattccctactctcaaaagttgtgtgaaataatcacccccagttgtattaaactgctaagttttggggtagtgtgttacacagcaataaatcataaatacaacatccaagcaataaatttctatgataaatacata

SEQ ID NO: 361047 - DNA, 459 bp, Homo sapiens
gcctccaattctggtcctttcagctgtggccaggttagcaggatcgattcacagaaagaaccatttggggaacttctctttaaaagggactgaatttatgtcaagcttggaatgctgcagactcctctcctctattttttaaagtgaaactttacatgcaaagaagtttcagccctggctgggaacagtggctcatgcctgtaatcccaacactttgggagacccagccaggtgtttgagaccagccttagcaacatgacaaaaccccatctttacaaaaaaaagatacaaaaattggccaggtatggtggtgcacgcctgtactcccaaattctcagaaggctaaggtgagaggatcacttgagcctgggagggtaaggcttcagtgagctgagatcgtgccactgcactccagcctgggcaacagagtgacagtctgtcaaaaaaaaaaaaaaaaag

SEQ ID NO: 361048 - DNA, 421 bp, Homo sapiens
cagagtctcaagacaatctaagactggagacttagattccccagggttacccatgacttattgtcgaattacttccgctttttccatcctgtgattgaatgtctacctagagacttcatagtgtcatagaatccaagcataggaagggccatagtggggttcatcctggctaccacacatatgcattgcatccctaccccagcacacccactaagctgttgcccaacttcttcctaacaccttgggaaactggaagttcattacctcatcaggtagcttacagtttcagtcagttctccattagaaagttctgcctttaaaccaaacaccgcatgttctcactcataggtgggaattgaacaatgagatcacttggacacagggtggggaacatcacacaccggggcctgtcgtggggtgg

SEQ ID NO: 361049 - DNA, 3974 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361050 - DNA, 379 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccg

SEQ ID NO: 361051 - DNA, 463 bp, Homo sapiens
  misc_feature (389)..(389): n is a, c, g, or t
  misc_feature (425)..(425): n is a, c, g, or t
  misc_feature (439)..(439): n is a, c, g, or t
  misc_feature (449)..(449): n is a, c, g, or t
ggcggaccgaagttcgtcataggtttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaagacnggcgcatcttctcccatcagagaaaccccagccaangctccgttttcagngtgtaagatngtacctgatgggag

SEQ ID NO: 361052 - DNA, 576 bp, Homo sapiens
caggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctgg

SEQ ID NO: 361053 - DNA, 451 bp, Homo sapiens
tccgagtctcacacacacaccacacaccacacacacagtcgcacacacaccacacacacacaccacacactcaaatacaagaacctactgctaatgccaccactaccactgccaccactgatgaattaaaaacagtgacaaaagaccgtatggaagacattaaaatattgattgcatctccatctcctacccaccgtgactcgtgggtgactcgtggaaatgtccgtgggcatttccactgagtcacagaaagttctgttggacagtggatatagaagttggaaaagaatgatttttttaaaaatgagtgcttaatgaaaatagtcatttaagttggtaaaccggatcataaatcacaaaattctttgcccttgatatataatattagctgccatttatgaggtactagctaagtgtcagattcagtctaaatggttcatagtccttttct

SEQ ID NO: 361054 - DNA, 291 bp, Homo sapiens
acttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctagcgggaggctgaggcaggagaatggcgtgaacccgggaggcggaacttgcagtgagccgagatcacgccactgcactccagcctgggcgacagagcgagactccgtctca

SEQ ID NO: 361055 - DNA, 4630 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaaaaaaaaaaaaaaaaaaaaaaaaaaaaaaaaaaaaaaaaaaaaaaaaaaaaaaaaaaaaatcaacaaaaaaaaaagacacacatcaatctaaaataaaccttttcataggcgacagcactaattaatttactacacctcacttttttctaccaacgacgcctacctaactttattcaactcttattatatcacatcacatacccccctcactcatactaacatcttcctccatcaaataccattccagtcatcttctctatattacaagaaaccctccactcttgtttgctcctacacatctaccacacacactcccaacatatattcatcccgcgcgcaatcaacgaaaccacgcacactattcgtcccgctacacccccacccatcacgtcgcccgcaagaaaacagttccaccgtggaatagccccctccaactcatcaacaggcacgcgcaacaaacacaacacaagaccactcattacgctagacacaatgccaaccagagcacaacaccaagcactcaagcagacgaccgacccgatcataacacaaccaaccaagccagccccacgcacacaccacacataccaccccactcaacgacacaccagacacgccacaacacgaccaaacaaaa

SEQ ID NO: 361056 - DNA, 3678 bp, Homo sapiens
agtcttactgttcatttaagcaagatatgtgcaagacactgcattcttagtactggcagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361057 - DNA, 3112 bp, Homo sapiens
ggatcccgcgatagtgtccgatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361058 - DNA, 3273 bp, Homo sapiens
caggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361059 - DNA, 3951 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaaaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 361060 - DNA, 3597 bp, Homo sapiens
cgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaataaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg
